United States Patent
Badran et al.

(10) Patent No.: US 11,299,729 B2
(45) Date of Patent: Apr. 12, 2022

(54) VECTOR-BASED MUTAGENESIS SYSTEM

(71) Applicant: President and Fellows of Harvard College, Cambridge, MA (US)

(72) Inventors: Ahmed Hussein Badran, Dorchester, MA (US); David R. Liu, Lexington, MA (US)

(73) Assignee: President and Fellows of Harvard College, Cambridge, MA (US)

( * ) Notice: Subject to any disclaimer, the term of this patent is extended or adjusted under 35 U.S.C. 154(b) by 705 days.

(21) Appl. No.: 15/567,312

(22) PCT Filed: Apr. 15, 2016

(86) PCT No.: PCT/US2016/027795
§ 371 (c)(1),
(2) Date: Oct. 17, 2017

(87) PCT Pub. No.: WO2016/168631
PCT Pub. Date: Oct. 20, 2016

(65) Prior Publication Data
US 2018/0087046 A1    Mar. 29, 2018

Related U.S. Application Data

(60) Provisional application No. 62/149,378, filed on Apr. 17, 2015, provisional application No. 62/272,035, filed on Dec. 28, 2015.

(51) Int. Cl.
| | | |
|---|---|---|
| *C12N 15/70* | (2006.01) | |
| *C12N 9/48* | (2006.01) | |
| *C12N 15/10* | (2006.01) | |
| *C12N 9/12* | (2006.01) | |

(52) U.S. Cl.
CPC ......... *C12N 15/102* (2013.01); *C12N 9/1241* (2013.01); *C12N 9/48* (2013.01); *C12N 15/1058* (2013.01); *C12N 15/70* (2013.01)

(58) Field of Classification Search
None
See application file for complete search history.

(56) References Cited

U.S. PATENT DOCUMENTS

| | | |
|---|---|---|
| 5,057,432 A | 10/1991 | Wangersky et al. |
| 5,223,409 A | 6/1993 | Ladner et al. |
| 5,658,727 A | 8/1997 | Barbas et al. |
| 5,712,089 A | 1/1998 | Borrebaeck et al. |
| 5,821,047 A | 10/1998 | Garrard et al. |
| 5,880,275 A | 3/1999 | Fischhoff et al. |
| 5,965,124 A | 10/1999 | Feinberg et al. |
| 6,033,874 A | 3/2000 | Baum et al. |
| 6,156,509 A | 12/2000 | Schellenberger |
| 6,429,298 B1 | 8/2002 | Ellington et al. |
| 6,713,063 B1 | 3/2004 | Malvar et al. |
| 6,962,705 B2 | 11/2005 | Malvar et al. |
| 6,969,731 B1 | 11/2005 | Tang et al. |
| 7,064,249 B2 | 6/2006 | Corbin et al. |
| 7,070,982 B2 | 7/2006 | Malvar et al. |
| 9,023,594 B2 | 5/2015 | Liu et al. |
| 9,228,207 B2 | 1/2016 | Liu et al. |
| 9,267,127 B2 | 2/2016 | Liu et al. |
| 9,340,799 B2 | 5/2016 | Liu et al. |
| 9,340,800 B2 | 5/2016 | Liu et al. |
| 9,359,599 B2 | 6/2016 | Liu et al. |
| 9,394,537 B2 | 7/2016 | Liu et al. |
| 9,526,784 B2 | 12/2016 | Liu et al. |
| 9,567,589 B2 | 2/2017 | Jin et al. |
| 9,737,604 B2 | 8/2017 | Jin et al. |
| 9,766,216 B2 | 9/2017 | Wada et al. |
| 9,771,574 B2 | 9/2017 | Liu et al. |
| 10,179,911 B2 | 1/2019 | Liu et al. |
| 10,227,581 B2 | 3/2019 | Liu et al. |
| 10,336,997 B2 | 7/2019 | Liu et al. |
| 10,392,674 B2 | 8/2019 | Liu et al. |
| 10,597,679 B2 | 3/2020 | Liu et al. |
| 10,612,011 B2 | 4/2020 | Liu et al. |
| 10,682,410 B2 | 6/2020 | Liu et al. |
| 10,920,208 B2 | 2/2021 | Liu et al. |
| 2002/0132327 A1 | 9/2002 | Hay et al. |
| 2003/0119764 A1 | 6/2003 | Loeb et al. |

(Continued)

FOREIGN PATENT DOCUMENTS

| | | |
|---|---|---|
| EP | 0289479 A2 | 11/1988 |
| EP | 3115457 A1 | 1/2017 |

(Continued)

OTHER PUBLICATIONS

Hendricks et al., DNA Repair, 1, 645-659 (Year: 2002).*
Canitrot et al. Overexpression of DNA polymerase β in cell results in a mutator phenotype and a decreased sensitivity to anticancer drugs. Oct. 1998. Proc. Natl. Acad. Sci. USA. vol. 95, pp. 12586-11590. (Year: 1998).*
Radany et al. Increased spontaneous mutation frequency in human cells expressing the phage PBS2-encoded inhibitor of uracil-DNA glycosylase. Sep. 15, 2000. Mutation Research/DNA Repair. vol. 461, Issue 1, pp. 41-58. (Year: 2000).*

(Continued)

*Primary Examiner* — Channing S Mahatan
(74) *Attorney, Agent, or Firm* — Wolf, Greenfield & Sacks, P.C.

(57) ABSTRACT

Strategies, reagents, methods, and systems for modulating the mutation rate in cells are provided herein. The strategies, reagents, methods, and systems are broadly applicable for the modulation of mutation rates in cells where high mutation rates and/or control over a broad range of mutation rates is desired, for example, in the context of diversifying a nucleic acid sequence or a plurality of such sequences within a population of cells, for the generation of diversified nucleic acid libraries, and for directed evolution of nucleic acids and encoded products.

26 Claims, 108 Drawing Sheets

Specification includes a Sequence Listing.

(56) References Cited

U.S. PATENT DOCUMENTS

| | | | |
|---|---|---|---|
| 2003/0167533 A1 | 9/2003 | Yadav et al. | |
| 2003/0203480 A1 | 10/2003 | Kovesdi et al. | |
| 2005/0019753 A1 | 1/2005 | Kukolj et al. | |
| 2005/0100973 A1 | 5/2005 | Steward et al. | |
| 2006/0112447 A1 | 5/2006 | Bogdanova et al. | |
| 2006/0160222 A1* | 7/2006 | Rozwadowski ... | C12N 15/8213 435/468 |
| 2006/0166319 A1 | 7/2006 | Chan et al. | |
| 2008/0220502 A1 | 9/2008 | Schellenberger et al. | |
| 2009/0215110 A1 | 8/2009 | Gibson et al. | |
| 2009/0227463 A1 | 9/2009 | Reif et al. | |
| 2009/0300777 A1 | 12/2009 | Nakayama | |
| 2010/0297180 A1 | 11/2010 | Shone | |
| 2011/0177495 A1 | 7/2011 | Liu et al. | |
| 2011/0318385 A1 | 12/2011 | Jackson et al. | |
| 2012/0128649 A1 | 5/2012 | Chaddock et al. | |
| 2013/0059931 A1 | 3/2013 | Petersen-Mahrt et al. | |
| 2013/0117869 A1 | 5/2013 | Duchateau et al. | |
| 2013/0345064 A1 | 12/2013 | Liu et al. | |
| 2013/0345065 A1 | 12/2013 | Hassibi et al. | |
| 2014/0201858 A1 | 7/2014 | Ostertag et al. | |
| 2015/0056177 A1 | 2/2015 | Liu et al. | |
| 2015/0259721 A1 | 9/2015 | Van Brunt et al. | |
| 2015/0275202 A1 | 10/2015 | Liu et al. | |
| 2016/0002301 A1 | 1/2016 | Je et al. | |
| 2016/0201040 A1 | 7/2016 | Liu et al. | |
| 2016/0348096 A1 | 12/2016 | Liu et al. | |
| 2017/0009224 A1 | 1/2017 | Liu et al. | |
| 2017/0029473 A1 | 2/2017 | Liu et al. | |
| 2017/0029844 A1 | 2/2017 | Ball et al. | |
| 2017/0044520 A1 | 2/2017 | Liu et al. | |
| 2017/0233708 A1 | 8/2017 | Liu et al. | |
| 2018/0057545 A9 | 3/2018 | Liu et al. | |
| 2018/0237758 A1 | 8/2018 | Liu et al. | |
| 2019/0219575 A1 | 7/2019 | Gray et al. | |
| 2019/0256842 A1 | 8/2019 | Liu et al. | |
| 2019/0276816 A1 | 9/2019 | Liu et al. | |
| 2019/0276873 A1 | 9/2019 | Dong et al. | |
| 2020/0071722 A1 | 3/2020 | Liu et al. | |
| 2020/0216833 A1 | 7/2020 | Liu et al. | |
| 2020/0255868 A1 | 8/2020 | Liu et al. | |
| 2020/0271587 A1 | 8/2020 | Xiao et al. | |
| 2020/0323984 A1 | 10/2020 | Liu et al. | |

FOREIGN PATENT DOCUMENTS

| | | |
|---|---|---|
| JP | H0937764 A | 2/1997 |
| JP | 2011-081011 | 4/2011 |
| WO | WO-90/2809 A1 | 3/1990 |
| WO | WO-91/17271 A1 | 11/1991 |
| WO | WO-92/01047 A1 | 1/1992 |
| WO | WO-92/09690 A2 | 6/1992 |
| WO | WO-92/15679 A1 | 9/1992 |
| WO | WO-92/18619 A1 | 10/1992 |
| WO | WO-92/20791 A1 | 11/1992 |
| WO | WO-93/01288 A1 | 1/1993 |
| WO | WO 94/18316 A2 | 8/1994 |
| WO | WO-96/04403 A1 | 2/1996 |
| WO | WO-98/32845 A1 | 7/1998 |
| WO | WO-00/71694 A1 | 11/2000 |
| WO | WO-01/05950 A2 | 1/2001 |
| WO | WO-01/61049 A1 | 8/2001 |
| WO | WO-2005/081632 A2 | 9/2005 |
| WO | WO-07/066923 A1 | 6/2007 |
| WO | WO-08/005529 A2 | 1/2008 |
| WO | WO-2009/082488 A2 | 7/2009 |
| WO | WO-2009/108180 A2 | 9/2009 |
| WO | WO 2010/028347 A2 | 3/2010 |
| WO | WO-2010/028347 A2 | 3/2010 |
| WO | WO 2011/039518 A2 | 4/2011 |
| WO | WO-2011/066747 A1 | 6/2011 |
| WO | WO-2011/147590 A2 | 12/2011 |
| WO | WO 2012/088381 A2 | 6/2012 |
| WO | WO-2012/088381 A2 | 6/2012 |
| WO | WO 2012/138927 A2 | 10/2012 |
| WO | WO 2013/047844 | 4/2013 |
| WO | WO-2014/039585 A2 | 3/2014 |
| WO | WO-2014/157820 A1 | 10/2014 |
| WO | WO-2014/158593 A1 | 10/2014 |
| WO | WO 2015/134121 A2 | 9/2015 |
| WO | WO 2015/193897 A1 | 12/2015 |
| WO | WO 2016/077052 A9 | 5/2016 |
| WO | WO 2016/168631 A1 | 10/2016 |
| WO | WO 2017/015559 A2 | 1/2017 |
| WO | WO 2017/070632 A2 | 4/2017 |
| WO | WO 2018/009903 A2 | 1/2018 |
| WO | WO 2018/027078 A1 | 2/2018 |
| WO | WO 2018/039438 A1 | 3/2018 |
| WO | WO 2018/109447 A1 | 6/2018 |
| WO | WO 2018/136939 A1 | 7/2018 |
| WO | WO 2019/040935 A1 | 2/2019 |
| WO | WO 2019/067815 A2 | 4/2019 |

OTHER PUBLICATIONS

Ziemann et al. Gene name errors are widespread in the scientific literature. 2016. Genome Biology. vol. 17, No. 177, 3 pages. (Year: 2016).*

International Search Report and Written Opinion for PCT/US2014/052231, dated Jan. 30, 2015.

Preliminary Report on Patentability for PCT/US2014/052231, dated Mar. 3, 2016.

International Preliminary Report on Patentability for PCT/US2018/14867 dated Aug. 1, 2019.

Invitation to Pay Additional Fees for PCT/US2018/040692 dated Sep. 12, 2018.

International Search Report and Written Opinion for PCT/US2018/040692 dated Nov. 15, 2018.

International Preliminary Report on Patentability for PCT/US2018/040692 dated Jan. 16, 2020.

Invitation to Pay Additional Fees for PCT/US2018/051557, dated Jan. 4, 2019.

International Search Report and Written Opinion for PCT/US2018/051557, dated Feb. 25, 2019.

International Preliminary Report on Patentability for PCT/US2018/051557, dated Apr. 2, 2020.

International Search Report and Written Opinion for PCT/US2018/044242, dated Nov. 21, 2018.

International Search Report and Written Opinion for Application No. PCT/US2019/037216 dated Sep. 4, 2019.

Invitation to Pay Additional Fees for Application No. PCT/US18/48134 dated Nov. 19, 2018.

International Search Report and Written Opinion for Application No. PCT/US18/48134 dated Jan. 22, 2019.

International Preliminary Report on Patentability for Application No. PCT/US 18/48134 dated Mar. 5, 2020.

[No Author Listed] NCBI Accession No. XP_015843220.1. C ->U editing enzyme APOBEC-1 [Peromyscus maniculatus bairdii], XP002793540.

[No Author Listed] NCBI Accession No. XP_021505673.1. C ->U editing enzyme APOBEC-1 [Meriones unguiculatus], XP002793541.

Ahluwalia et al., Novel mutator mutants of E. coli nrdAB ribonucleotide reductase: insight into allosteric regulation and control of mutation rates. DNA Repair (Amst). May 1, 2012;11(5):480-7. doi: 10.1016/j.dnarep.2012.02.001. Epub Mar. 13, 2012.

Al Mamun, Elevated expression of DNA polymerase II increases spontaneous mutagenesis in Escherichia coli. Mutat Res. Dec. 1, 2007;625(1-2):29-39. Epub May 18, 2007.

Aronshtam et al., Dominant negative mutator mutations in the mutL gene of Escherichia coli. Nucleic Acids Res. Jul. 1, 1996;24(13):2498-504.

Badran et al., In vivo continuous directed evolution. Curr Opin Chem Biol. Feb. 2015;24:1-10. doi: 10.1016/j.cbpa.2014.09.040. Epub Nov. 7, 2014.

Balashov et al., Specificity of spontaneous mutations induced in mutA mutator cells. Mutat Res. Apr. 14, 2004;548(1-2):9-18.

(56) References Cited

OTHER PUBLICATIONS

Cao et al., Characterization of the transgenic rice event TT51-1 and construction of a reference plasmid. J Agric Food Chem. Aug. 24, 2011;59(16):8550-9. doi: 10.1021/jf201699s. Epub Jul. 21, 2011.
CAS Registry No. 50-00-0. Formaldehyde. PubChem Compound Database; CID=712, https://pubchem.ncbi.nlm.nih.gov/compound/712 (accessed Jan. 17, 2018).
CAS Registry No. 107-22-2. GLYOXAL. PubChem Compound Database; CID=7860, https://pubchem.ncbi.nlm.nih.gov/compound/7860 (accessed Jan. 17, 2018).
CAS Registry No. 133-06-2. CAPTAN. PubChem Compound Database; CID=8606, https://pubchem.ncbi.nlm.nih.gov/compound/8606 (accessed Jan. 17, 2018).
CAS Registry No. 2435-76-9. 5-Diazouracil. PubChem Compound Database; CID=73266, https://pubchem.ncbi.nlm.nih.gov/compound/73266 (accessed Jan. 17, 2018).
CAS Registry No. 26628-22-8. Sodium Azide. PubChem Compound Database; CID=33557, https://pubchem.ncbi.nlm.nih.gov/compound/33557 (accessed Jan. 17, 2018).
CAS Registry No. 320-67-2. 5-azacytidine. PubChem Compound Database; CID=9444, https://pubchem.ncbi.nlm.nih.gov/compound/9444 (accessed Jan. 17, 2018).
CAS Registry No. 3688-53-7. PubChem Compound Database; CID=19390, https://pubchem.ncbi.nlm.nih.gov/compound/19390 (accessed Jan. 17, 2018).
CAS Registry No. 4245-77-6. N-Ethyl-N'-nitro-N-nitrosoguanidine. PubChem Compound Database; CID=5359974, https://pubchem.ncbi.nlm.nih.gov/compound/5359974 (accessed Jan. 17, 2018).
CAS Registry No. 452-06-2. 2-aminopurine. PubChem Compound Database; CID=9955, https://pubchem.ncbi.nlm.nih.gov/compound/9955 (accessed Jan. 17, 2018).
CAS Registry No. 50-44-2. 6-Mercaptopurine. PubChem Compound Database; CID=667490, https://pubchem.ncbi.nlm.nih.gov/compound/667490 (accessed Jan. 17, 2018).
CAS Registry No. 56-57-5. 4-Nitroquinoline N-oxide. PubChem Compound Database; CID=5955, https://pubchem.ncbi.nlm.nih.gov/compound/5955 (accessed Jan. 17, 2018).
CAS Registry No. 57294-74-3. N4-Aminocytidine. PubChem Compound Database; CID=13887579, https://pubchem.ncbi.nlm.nih.gov/compound/13887579 (accessed Jan. 17, 2018).
CAS Registry No. 62-50-0. Ethyl Methanesulfonate. PubChem Compound Database; CID=6113, https://pubchem.ncbi.nlm.nih.gov/compound/6113 (accessed Jan. 17, 2018).
CAS Registry No. 66-27-3. Methyl Methanesulfonate. PubChem Compound Database; CID-4156, https://pubchem.ncbi.nlm.nih.gov/compound/4156 (accessed Jan. 17, 2018).
CAS Registry No. 70-25-7. 1-Methyl-3-nitro-1-nitrosoguanidine. PubChem Compound Database; CID=9562060, https://pubchem.ncbi.nlm.nih.gov/compound/9562060 (accessed Jan. 17, 2018).
CAS Registry No. 732-11-6. Phosmet. PubChem Compound Database; CID=12901, https://pubchem.ncbi.nlm.nih.gov/compound/12901 (accessed Jan. 17, 2018).
CAS Registry No. 75-91-2. Tert-Butyl Hydroperoxide. PubChem Compound Database; CID=6410, https://pubchem.ncbi.nlm.nih.gov/compound/6410 (accessed Jan. 17, 2018).
CAS Registry No. 759-73-9. 1-Ethyl-1-nitrosourea. PubChem Compound Database; CID=12967, https://pubchem.ncbi.nlm.nih.gov/compound/12967 (accessed Jan. 17, 2018).
CAS Registry No. 77439-76-0. 3-Chloro-4-(dichloromethyl)-5-hydroxy-2(5H)-furanone. PubChem Compound Database; CID=53665, https://pubchem.ncbi.nlm.nih.gov/compound/53665 (accessed Jan. 17, 2018).
CAS Registry No. 80-15-9. Cumene Hydroperoxide. PubChem Compound Database; CID=6629, https://pubchem.ncbi.nlm.nih.gov/compound/6629 (accessed Jan. 17, 2018).
CAS Registry No. 820-60-0. N-Methyl-N-nitrosourea. PubChem Compound Database; CID=12699, https://pubchem.ncbi.nlm.nih.gov/compound/12699 (accessed Jan. 17, 2018).

Cattaneo et al., SEL1L affects human pancreatic cancer cell cycle and invasiveness through modulation of PTEN and genes related to cell-matrix interactions. Neoplasia. 2005;7(11): 1030-1038.
Chen, Clinical uses of botulinum neurotoxins: current indications, limitations and future developments. Toxins (Basel). 2012;4(10):913-939.
Clokte et al., Bacteriophages: Methods and Protocols, vol. 1: Isolation, Characterization, and Interactions (Methods in Molecular Biology). Dec. 2008, 1st Edition. Humana Press. ISBN: 1588296822.
Clokte et al., Bacteriophages: Methods and Protocols, vol. 2: Molecular and Applied Aspects (Methods in Molecular Biology). Dec. 2008, 1st Edition. Humana Press. ISBN: 1603275649.
Cupples et al., A set of lacZ mutations in *Escherichia coli* that allow rapid detection of each of the six base substitutions. Proc Natl Acad Sci U S A. Jul. 1989;86(14):5345-9.
Dahlgren et al., A novel mutation in ribosomal protein S4 that affects the function of a mutated RF1. Biochimie. Aug. 2000;82(8):683-91.
Deribe, Mechanistic insights into the role of truncating PREX2 mutations in melanoma. Mol Cell Oncol. 2016;3(3):e1160174.
Dickinson et al., A system for the continuous directed evolution of proteases rapidly reveals drugresistance mutations. Nat Commun. Oct. 30, 2014;5:5352. doi: 10.1038/ncomms6352.
Fijalkowska et al., Genetic requirements and mutational specificity of the *Escherichia coli* SOS mutator activity. J Bacteriol. Dec. 1997;179(23):7435-45.
Gabrovsky et al., Mutator effects in *Escherichia coli* caused by the expression of specific foreign genes. J Bacteriol. Jul. 2005;187(14):5044-8.
Garibyan et al., Use of the rpoB gene to determine the specificity of base substitution mutations on the *Escherichia coli* chromosome. DNA Repair (Amst). May 13, 2003;2(5):593-608.
GenBank Accession No. J01600.1. Brooks et al., *E.coli* dam gene coding for DNA adenine methylase. Apr. 26, 1993.
GenBank Accession No. M10107.1 Kitagawa et al., *E.coli* umu operon: umuD and umuC genes encoding rec A and lexA dependent UV repair enzyme. Apr. 26, 1993.
GenBank Accession No. U07651.1. Lu, *Escherichia coli* K12 negative regulator of replication initiation (seqA) gene, complete cds. Jul. 19, 1994.
Glassner et al., Generation of a strong mutator phenotype in yeast by imbalanced base excision repair. Proc Natl Acad Sci U S A. Aug. 18, 1998;95(17):9997-10002.
Gon et al., Increase in dNTP pool size during the DNA damage response plays a key role in spontaneous and induced-mutagenesis in *Escherichia coli*. Proc Natl Acad Sci U S A. Nov. 29, 2011; 108(48): 19311-6. doi: 10.1073/pnas.1113664108. Epub Nov. 14, 2011.
Guilinger et al., Broad specificity profiling of TALENs results in engineered nucleases with improved DNA-cleavage specificity. Nat Methods. Apr. 2014;11(4):429-35. doi: 10.1038/nmeth.2845. Epub Feb. 16, 2014.
Harris et al., Measurement of enzyme activity. Methods Enzymol. 2009;463:57-71.
Harris et al., RNA editing enzyme APOBEC1 and some of its homologs can act as DNA mutators. Mol Cell. Nov. 2002;10(5):1247-53.
Hasegawa et al., Spontaneous mutagenesis associated with nucleotide excision repair in *Escherichia coli*. Genes Cells. May 2008;13(5):459-69. doi: 10.1111/j.1365-2443.2008.01185.x.
Herman et al., *Escherichia coli* K-12 clones that overproduce dam methylase are hypermutable. J Bacteriol. Jan. 1981;145(1):644-6.
Horst et al., *Escherichia coli* mutator genes. Trends Microbiol. Jan. 1999;7(1):29-36.
Junop et al., In vitro and in vivo studies of MutS, MutL and MutH mutants: correlation of mismatch repair and DNA recombination. DNA Repair (Amst). Apr. 2, 2003;2(4):387-405.
Kang et al., Interaction of SeqA and Dam methylase on the hemimethylated origin of *Escherichia coli* chromosomal DNA replication. J Biol Chem. Apr. 23, 1999;274(17):11463-8.
Kehoe et al., Filamentous phage display in the new millennium. Chem Rev. Nov. 2005;105(11):4056-72.

(56) References Cited

OTHER PUBLICATIONS

Kim et al., DJ-1, a novel regulator of the tumor suppressor PTEN. Cancer Cell. 2005;7(3):263-273.
Kim et al., Increasing the genome-targeting scope and precision of base editing with engineered Cas9-cytidine deaminase fusions. Nature Biotechnology; Feb. 13, 2007; 35(4): 371-376.
Klapacz et al., Frameshift mutagenesis and microsatellite instability induced by human alkyladenine DNA glycosylase. Mol Cell. Mar. 26, 2010;37(6):843-53. doi: 10.1016/j.molcel.2010.01.038.
Kohli et al., A portable hot spot recognition loop transfers sequence preferences from APOBEC family members to activation-induced cytidine deaminase. J Biol Chem. Aug. 21, 2009;284(34):22898-904. doi: 10.1074/jbc.M109.025536. Epub Jun. 26, 2009.
Komor et al., Programmable editing of a target base in genomic DNA without double-stranded DNA cleavage. Nature. May 19, 2016;533(7603):420-4. doi: 10.1038/nature17946. Epub Apr. 20, 2016.
Lada et al., Mutator effects and mutation signatures of editing deaminases produced in bacteria and yeast. Biochemistry (Mosc). Jan. 2011;76(1):131-46.
Lai et al., A new approach to random mutagenesis in vitro. Biotechnol Bioeng. Jun. 20, 2004;86(6):622-7.
Laskowska et al., IbpA and IbpB, the new heat-shock proteins, bind to endogenous *Escherichia coli* proteins aggregated intracellularly by heat shock. Biochimie. 1996;78(2): 117-22.
Leconte et al., A population-based experimental model for protein evolution: effects of mutation rate and selection stringency on evolutionary outcomes. Biochemistry. Feb. 26, 2013;52(8):1490-9. doi: 10.1021/bi3016185. Epub Feb. 14, 2013.
Lei et al., Efficient targeted gene disruption in Xenopus embryos using engineered transcription activator-like effector nucleases (TALENs). PNAS Oct. 23, 2012;109(43):17484-17489; https://doi.org/10.1073/pnas.1215421109.
Lu, The destructive effect of botulinum neurotoxins on the SNARE protein: SNAP-25 and synaptic membrane fusion. PeerJ. 2015;3:e1065. Published Jun. 30, 2015.
Luan et al., Genome replication engineering assisted continuous evolution (GREACE) to improve microbial tolerance for biofuels production. Biotechnol Biofuels. Sep. 27, 2013;6(1):137. doi: 10.1186/1754-6834-6-137.
Lynch, Evolution of the mutation rate. Trends Genet. Aug. 2010;26(8):345-52. doi: 10.1016/j.tig.2010.05.003. Epub Jun. 30, 2010.
Mackie et al., Addition of *Escherichia coli* K-12 growth observation and gene essentiality data to the EcoCyc database. J Bacteriol. Mar. 2014;196(5):982-8. doi: 10.1128/JB.01209-13. Epub Dec. 20, 2013.
Maeder et al., Robust, synergistic regulation of human gene expression using TALE activators. Nat Methods. Mar. 2013;10(3):243-5. doi: 10.1038/nmeth.2366. Epub Feb. 10, 2013.
Maki et al., A strong mutator effect caused by an amino acid change in the alpha subunit of DNA polymerase III of *Escherichia coli*. J Biol Chem. Mar. 15, 1991;266(8):5055-61.
Masuyer et al., Engineered botulinum neurotoxins as new therapeutics. Annu Rev Pharmacol Toxicol. 2014;54:27-51.
McNaughton et al., Mammalian cell penetration, siRNA transfection, and DNA transfection by supercharged proteins. Proc Natl Acad Sci U S A. Apr. 14, 2009;106(15):6111-6. doi: 10.1073/pnas.0807883106. Epub Mar. 23, 2009.
Mihai et al., PTEN inhibition improves wound healing in lung epithelia through changes in cellular mechanics that enhance migration. Am J Physiol Lung Cell Mol Physiol. 2012;302(3):L287-L299.
Miller et al., A TALE nuclease architecture for efficient genome editing. Nat Biotechnol. Feb. 2011;29(2): 143-8. doi:10.1038/nbt.1755. Epub Dec. 22, 2010.
Mussolino et al., TALE nucleases: tailored genome engineering made easy. Curr Opin Biotechnol. Oct. 2012;23(5):644-50. doi: 10.1016/j.copbio.2012.01.013. Epub Feb. 17, 2012.
Odsbu et al., Specific N-terminal interactions of the *Escherichia coli* SeqA protein are required to form multimers that restrain negative supercoils and form foci. Genes Cells. Nov. 2005; 10(11): 1039-49.
Oeemig et al., Solution structure of DnaE intein from Nostoc punctiforme: structural basis for the design of a new split intein suitable for site-specific chemical modification. FEBS Lett. May 6, 2009;583(9):1451-6.
Otto et al., The probability of fixation in populations of changing size. Genetics. Jun. 1997;146(2):723-33.
Petersen-Mahrt et al., AID mutates *E. coli* suggesting a DNA deamination mechanism for antibody diversification. Nature. Jul. 4, 2002;418(6893):99-103.
Pham et al., Mutator mutants of *Escherichia coli* carrying a defect in the DNA polymerase III tau subunit. Mol Microbiol. Feb. 2006;59(4):1149-61.
Posnick et al., Imbalanced base excision repair increases spontaneous mutation and alkylation sensitivity in *Escherichia coli*. J Bacteriol. Nov. 1999;181(21):6763-71.
Rasila et al., Critical evaluation of random mutagenesis by error-prone polymerase chain reaction protocols, *Escherichia coli* mutator strain, and hydroxylamine treatment. Anal Biochem. May 1, 2009;388(1):71-80. doi: 10.1016/j.ab.2009.02.008. Epub Feb. 10, 2009.
Rawlings et al., MEROPS: the database of proteolytic enzymes, their substrates and inhibitors. Nucleic Acids Res. Jan. 2014;42(Database issue):D503-9.
Ren et al., The mutA mistranslator tRNA-induced mutator phenotype requires recA and recB genes, but not the derepression of lexA-regulated functions. Mol Microbiol. May 1999;32(3):607-15.
Sambrook et al., Molecular Cloning: A Laboratory Manual, 2nd Ed., ed. (Cold Spring Harbor Laboratory Press: 1989).
Schaaper et al., Base selection, proofreading, and mismatch repair during DNA replication in *Escherichia coli*. J Biol Chem. Nov. 15, 1993;268(32):23762-5.
Schaaper et al., Spectra of spontaneous mutations in *Escherichia coli* strains defective in mismatch correction: the nature of in vivo DNA replication errors. Proc Natl Acad Sci U S A. Sep. 1987;84(17):6220-4.
Schaaper et al., The extreme mutator effect of *Escherichia coli* mutD5 results from saturation of mismatch repair by excessive DNA replication errors. EMBO J. Nov. 1989;8(11):3511-6.
Serrano-Heras et al., Protein p56 from the Bacillus subtilis phage phi29 inhibits DNA-binding ability of uracil-DNA glycosylase. Nucleic Acids Res. 2007;35(16):5393-401. Epub Aug. 13, 2007.
Shindo et al., A Comparison of Two Single-Stranded DNA Binding Models by Mutational Analysis of APOBEC3G. Biology (Basel). Aug. 2, 2012;1(2):260-76. doi: 10.3390/biology1020260.
Strauss et al., Role of the dinB gene product in spontaneous mutation in *Escherichia coli* with an impaired replicative polymerase. J Bacteriol. Dec. 2000;182(23):6742-50.
Tee et al., Polishing the craft of genetic diversity creation in directed evolution. Biotechnol Adv. Dec. 2013;31(8):1707-21. doi: 10.1016/j.biotechadv.2013.08.021. Epub Sep. 6, 2013.
Troll et al., The mutagenic footprint of low-fidelity Pol I ColE1 plasmid replication in *E. coli* reveals an extensive interplay between Pol I and Pol III. Curr Genet. Aug. 2014;60(3):123-34. doi: 10.1007/s00294-013-0415-9. Epub Nov. 2, 2013.
Wang et al., AID upmutants isolated using a high-throughput screen highlight the immunity/cancer balance limiting DNA deaminase activity. Nat Struct Mol Biol. Jul. 2009;16(7):769-76. doi: 10.1038/nsmb.1623. Epub Jun. 21, 2009.
Wang et al., Continuous directed evolutions of proteins with improved soluble expression. Nature Chemical Biology. Nat Publishing Group. Aug. 20, 2018; 14(10):972-980.
Webb et al., Production of catalytically inactive BoNT/A1 holoprotein and comparison with BoNT/A1 subunit vaccines against toxin subtypes A1, A2, and A3. Vaccine. 2009;27(33):4490-4497.
Wechsler et al., Isolation and characterization of thermo sensitive *Escherichia coli* mutants defective in deoxyribonucleic acid replication. J Bacteriol. Mar. 1973;113(3):1381-8.
Wijesinghe et al., Efficient deamination of 5-methylcytosines in DNA by human APOBEC3A, but not by AID or APOBEC3G. Nucleic Acids Res. Oct. 2012;40(18):9206-17. doi: 10.1093/nar/gks685. Epub Jul. 13, 2012.

(56) References Cited

OTHER PUBLICATIONS

Wong et al., A statistical analysis of random mutagenesis methods used for directed protein evolution. J Mol Biol. Jan. 27, 2006;355(4):858-71. Epub Nov. 17, 2005.
Wong et al., The diversity challenge in directed protein evolution. Comb Chem High Throughput Screen. May 2006;9(4):271-88.
Wu et al., Dominant negative mutator mutations in the mutS gene of Escherichia coli. J Bacteriol. Sep. 1994;176(17):5393-400.
Yamamoto et al., The ons and offs of inducible transgenic technology: a review. Neurobiol Dis. Dec. 2001;8(6):923-32.
Yamamoto et al., Virological and immunological bases for HIV-1 vaccine design. Uirusu 2007;57(2):133-139. https://doi.org/10.2222/jsv.57.133.
Yang et al., Identification of mutator genes and mutational pathways in Escherichia coli using a multicopy cloning approach. Molecular Microbiology. 2004;53(1):283-95.
Yang et al., Metagenomic DNA fragments that affect Escherichia coli mutational pathways. Mol Microbiol. Aug. 2006;61(4):960-77.
Yeung et al., Interaction of metronidazole with DNA repair mutants of Escherichia coli. Antimicrobial agents and chemotherapy. Jan. 1984; 25(1):65-70. doi: 10.1128/AAC.25.1.65.
Agarwal et al., Mode of VAMP substrate recognition and inhibition of Clostridium botulinum neurotoxin F. Nat Struct Mol Biol. Jul. 2009;16(7):789-94. doi: 10.1038/nsmb.1626. Epub Jun. 21, 2009.
Bade et al., Botulinum neurotoxin type D enables cytosolic delivery of enzymatically active cargo proteins to neurones via unfolded translocation intermediates. J Neurochem. Dec. 2004;91(6):1461-72.
Binz et al., Clostridial neurotoxins: mechanism of SNARE cleavage and outlook on potential substrate specificity reengineering. Toxins. Apr. 2010;2(4):665-82. Epub Apr. 13, 2010.
Box et al., A multi-domain protein system based on the HC fragment of tetanus toxin for targeting DNA to neuronal cells. J Drug Target. Jul. 2003;11(6):333-43. doi: 10.1080/1061186310001634667.
Chaddock et al., Inhibition of vesicular secretion in both neuronal and nonneuronal cells by a retargeted endopeptidase derivative of Clostridium botulinum neurotoxin type A. Infect. Immun. May 2000;68(5):2587-93.
Chaineau et al., Multiple roles of the vesicular-SNARE TI-VAMP in post-Golgi and endosomal trafficking. FEBS Letters. Oct. 2009;583:3817-26.
Chen et al., Engineering botulinum neurotoxin to extend therapeutic intervention. PNAS. Jun. 2009;106(23):9180-4.
Chen et al., SNARE-mediated membrane fusion. Nat Rev Mol Cell Biol. Feb. 2001;2(2):98-106.
Chen et al., VAMP8 facilitates cellular proliferation and temozolomide resistance in human glioma cells. Neuro-Oncology. 2015;17(3):407-18. Epub Sep. 10, 2014.
Chin, Expanding and reprogramming the genetic code of cells and animals. Annu Rev Biochem. 2014;83:379-408. doi: 10.1146/annurev-biochem-060713-035737. Epub Feb. 10, 2014.
Craik et al., Proteases as therapeutics. Biochem J. Apr. 2011;435(1):16 pages.
Duggan et al., Inhibition of Release of Neurotransmitters from Rat Dorsal Root Ganglia by a Novel Conjugate of a Clostridium botulinum Toxin A Endopeptidase Fragment and Erythrina cristagalli Lectin. The Journal of Biological Chemistry. Sep. 2002;277(38):34846-52.
Feng et al., Exo1: A new chemical inhibitor of the exocytic pathway. PNAS. May 2003; 100(11):6469-74.
Foster et al., Re-engineering the target specificity of Clostridial neurotoxins—A route to novel therapeutics. Neurotoxicity Research. May 2006;9(2,3):101-7.
Foster et al., Targeted Secretion Inhibitors—Innovative Protein Therapeutics. Toxins. Dec. 2010;2:2795-815.
Fu et al., Promises and Pitfalls of Intracellular Delivery of Proteins. Bioconjugate Chemistry. Aug. 2014;25:1602-8.
Gill, Bacterial Toxins: a Table of Letal Amounts. Microbiological Reviews. Mar. 1982;46(1):86-94.
Goodnough et al., Development of a delivery vehicle for intracellular transport of botulinum neurotoxin antagonists. FEBS Lett. Feb. 27, 2002;513(2-3): 163-8.
Guzman et al., Tight regulation, modulation, and high-level expression by vectors containing the arabinose PBAD promoter. J Bacteriol. 1995; 177(14):4121-4130.
Hedstrom et al., Converting trypsin to chymotrypsin: the role of surface loops. Science. Mar. 1992;255(5049): 1249-53.
Ho et al., Recombinant botulinum neurotoxin A heavy chainbased delivery vehicles for neuronal cell targeting. Protein Engineering, Design & Selection. 2011;24(3):247-53. Epub Nov. 4, 2010.
Kohler, A yeast-based growth assay for the analysis of site-specific proteases. Nucleic Acids Res. 2003;31(4):e16. 5 pages.
Lebeda et al., The Zinc-Dependent Protease Activity of the Botulinum Neurotoxins. Toxins. May 2010;2:978-97.
Liu et al., Adding new chemistries to the genetic code. Annu Rev Biochem. 2010;79:413-44. doi: 10.1146/annurev.biochem.052308.105824.
Pickett et al., Towards New Uses of Botulinum Toxin as a Novel Therapeutic Tool. Toxins. Jan. 2011;3:63-81.
Pogson et al., Engineering Next Generation Proteases. Curr Opin Biotechnol. Aug. 2009;20(4):390-7.
Rossetto et al., Botulinum neurotoxins: genetic, structural and mechanistic insights. Nat Rev Microbiol. Aug. 2014;12(8):535-49. doi: 10.1038/nrmicro3295. Epub Jun. 30, 2014.
Sikorra et al., Substrate Recognition Mechanism of VAMP/Synaptobrevin-cleaving Clostridial Neurotoxins. Journal of Biological Chemistry. 2008;283:21145-52. Epub May 29, 2008.
Somm et al., A botulinum toxin—drived targeted secretion inihibitor downregulates the GH/IGF1 axis. The Journal of Clinical Investigation. Sep. 2012;122(9):3295-306.
Steffen et al., MT1-MMP-Dependent Invasion Is Regulated by TI-VAMP/VAMP7. Current Biology. Jun. 2008;18:926-31.
Tsai et al., Targeting botulinum neurotoxin persistence by the ubiquitin-proteasome system. PNAS. Sep. 2010; 107(38):16554-9.
Varadarajan et al., Engineering of protease variants exhibiting high catalytic activity and exquisite substrate selectivity. PNAS. May 2005;102(19):6855-60.
Varadarajan et al., Highly active and selective endopeptidases with programmed substrate specificities. Nat Chem Biol. May 2008;4(5):290-4.
Wang et al., Syntaxin Requirement for Ca2+-Triggered Exocytosis in Neurons and Endocrine Cells Demonstrated with an Engineered Neurotoxin. Boiochemistry. Apr. 2011;50(14):2711-3.
Williams et al., SNAP23, Syntaxin4, and vesicle-associated membrane protein 7 (VAMP7) mediate trafficking of membrane type 1—matrix metalloproteinase (MT1-MMP) during invadopodium formation and tumor cell invasion. MBoC. Jul. 2014;25:2061-70.
Yeh et al., Retargeted Clostridial neurotoxins as Novel Agents for Treating Chronic Diseases. Biochemistry. Nov. 2011;50:10419-21.
Yi et al., Engineering of TEV protease variants by yeast ER sequestration screening (YESS) of combinatorial libraries. PNAS. Apr. 2013;110(18):7229-34.
Ahluwalia et al., Hypermutability and error catastrophe due to defects in ribonucleotide reductase. Proc Natl Acad Sci USA. Nov. 12, 2013;110(46):18596-601. doi: 10.1073/pnas. 1310849110. Epub Oct. 28, 2013.
Akopian et al., Chimeric recombinases with designed DNA sequence recognition. Proc Natl Acad Sci U S A. Jul. 22, 2003;100(15):8688-91. Epub Jul. 1, 2003.
Armstrong et al., Chapters. Vectors for Phage Display. In: Phage Display of Peptides and Proteins. Kay et al., eds. Academic Press. San Diego, CA. 1996:35-53.
Badran et al., Continuous evolution of Bacillus thuringiensis toxins overcomes insect resistance. Nature. May 5, 2016;533(7601):58-63. doi: 10.1038/nature17938. Epub Apr. 27, 2016.
Badran et al., Development of potent in vivo mutagenesis plasmids with broad mutational spectra. Nat Commun. Oct. 7, 2015;6:8425. doi: 10.1038/ncomms9425.
Baker et al., Chemical complementation: a reaction-independent genetic assay for enzyme catalysis. Proc Natl Acad Sci U S A. Dec. 24, 2002;99(26):16537-42. Epub Dec. 13, 2002.

(56) References Cited

OTHER PUBLICATIONS

Barbas et al., Assembly of combinatorial antibody libraries on phage surfaces: the gene III site. Proc Natl Acad Sci U S A. Sep. 15, 1991;88(18):7978-82.

Bennet et al., Unlocking of the filamentous bacteriophage virion during infection is mediated by the C domain of pIII. J Mol Biol. Feb. 17, 2006;356(2):266-73. Epub Dec. 9, 2005.

Birling et al., Site-specific recombinases for manipulation of the mouse genome. Methods Mol Biol. 2009;561:245-63. doi: 10.1007/978-1-60327-019-9_16.

Bloom et al., Evolving strategies for enzyme engineering. Curr Opin Struct Biol. Aug. 2005;15(4):447-52.

Boch et al., Breaking the code of DNA binding specificity of TAL-type III effectors. Science. Dec. 11, 2009;326(5959):1509-12. Doi: 10.1126/science.1178811.

Boeke et al., Effects of bacteriophage f1 gene III protein on the host cell membrane. Mol Gen Genet. 1982;186(2):185-92.

Boersma et al., Selection strategies for improved biocatalysts. FEBS J. May 2007;274(9):2181-95.

Bolusani et al., Evolution of variants of yeast site-specific recombinase Flp that utilize native genomic sequences as recombination target sites. Nucleic Acids Res. 2006;34(18):5259-69. Epub Sep. 26, 2006.

Braun et al., Immunogenic duplex nucleic acids are nuclease resistant. J Immunol. Sep. 15, 1988;141(6):2084-9.

Breaker et al., Emergence of a replicating species from an in vitro RNA evolution reaction. Proc Natl Acad Sci U S A. Jun. 21, 1994;91(13):6093-7.

Brieba et al., Role of T7 RNA polymerase His784 in start site selection and initial transcription. Biochemistry. Apr. 23, 2002;41(16):5144-9.

Buchholz et al., Alteration of Cre recombinase site specificity by substrate-linked protein evolution. Nat Biotechnol. Nov. 2001;19(11):1047-52.

Caldwell et al., Randomization of Genes by PCR Mutagenesis. PCR Methods Applic. 1992;2:28-33.

Camps et al., Targeted gene evolution in Escherichia coli using a highly error-prone DNA polymerase I. Proc Natl Acad Sci U S A. Aug. 19, 2003;100(17):9727-32. Epub Aug. 8, 2003.

Carlson et al., Negative selection and stringency modulation in phage-assisted continuous evolution. Nat Chem Biol. Mar. 2014;10(3):216-22. doi: 10.1038/nchembio.1453. Epub Feb. 2, 2014. With Supplementary Results.

Chasteen et al., Eliminating helper phage from phage display. Nucleic Acids Res. 2006;34(21):e145. Epub Nov. 6, 2006.

Chaturvedi et al., Stabilization of triple-stranded oligonucleotide complexes: use of probes containing alternating phosphodiester and stereo-uniform cationic phosphoramidate linkages. Nucleic Acids Res. Jun. 15, 1996;24(12):2318-23.

Cheetham et al., Structural basis for initiation of transcription from an RNA polymerase-promoter complex. Nature. May 6, 1999;399(6731):80-3.

Chen et al., Information theory based T7-like promoter models: classification of bacteriophages and differential evolution of promoters and their polymerases. Nucleic Acids Res. Oct. 31, 2005;33(19):6172-87. Print 2005.

Clackson et al., Making antibody fragments using phage display libraries. Nature. Aug. 15, 1991;352(6336):624-8.

Click et al., Filamentous phage infection: required interactions with the TolA protein. J Bacteriol. Oct. 1997;179(20):6464-71.

Cobb et al., Directed evolution: an evolving and enabling synthetic biology tool. Curr Opin Chem Biol. Aug. 2012;16(3-4):285-91. doi: 10.1016/j.cbpa.2012.05.186. Epub Jun. 4, 2012.

Corey et al., Trypsin display on the surface of bacteriophage. Gene. Jun. 15, 1993;128(1):129-34.

Crameri et al., Display of biologically active proteins on the surface of filamentous phages: a cDNA cloning system for selection of functional gene products linked to the genetic information responsible for their production. Gene. Dec. 27, 1993;137(1):69-75.

Cwirla et al., Peptides on phage: a vast library of peptides for identifying ligands. Proc Natl Acad Sci U S A. Aug. 1990;87(16):6378-82.

Das et al., Viral evolution as a tool to improve the tetracycline-regulated gene expression system. J Biol Chem. Apr. 30, 2004;279(18):18776-82. Epub Feb. 2, 2004.

Datsenko et al., One-step inactivation of chromosomal genes in Escherichia coli K-12 using PCR products. Proc Natl Acad Sci U S A. Jun. 6, 2000;97(12):6640-5.

Davis et al., Viral mutagenesis as a means for generating novel proteins. J Virol. Feb. 2010;84(3): 1625-30. Epub Nov. 11, 2009.

De Haard et al., A large non-immunized human Fab fragment phage library that permits rapid isolation and kinetic analysis of high affinity antibodies. J Biol Chem. Jun. 25, 1999;274(26):18218-30.

Deussing, Targeted mutagenesis tools for modelling psychiatric disorders. Cell Tissue Res. Oct. 2013;354(1):9-25. doi: 10.1007/s00441-013-1708-5. Epub Sep. 10, 2013.

Dickinson et al., Experimental interrogation of the path dependence and stochasticity of protein evolution using phage-assisted continuous evolution. Proc Natl Acad Sci USA. May 2013;110(22):9007-12.

Dove et al., Conversion of the omega subunit of Escherichia coli RNA polymerase into a transcriptional activator or an activation target. Genes Dev. Mar. 1, 1998;12(5):745-54.

Doyon et al., Directed evolution and substrate specificity profile of homing endonuclease I-Scel. J Am Chem Soc. Feb. 22, 2006;128(7):2477-84.

Drake, A constant rate of spontaneous mutation in DNA-based microbes. Proc Natl Acad Sci U S A. Aug. 15, 1991;88(16):7160-4.

Durai et al., A bacterial one-hybrid selection system for interrogating zinc finger-DNA interactions. Comb Chem High Throughput Screen. May 2006;9(4):301-11.

Durniak et al., The structure of a transcribing T7 RNA polymerase in transition from initiation to elongation. Science. Oct. 24, 2008;322(5901):553-7.

Esvelt et al., A system for the continuous directed evolution of biomolecules. Nature. Apr. 28, 2011;472(7344):499-503. Epub Apr. 10, 2011.

Extended European Search Report for EP 09812363, dated Mar. 30, 2012.

Extended European Search Report for EP 16 20 3684, dated May 26, 2017.

Extended European Search Report for EP 17 16 0955, dated May 16, 2017.

Fijalkowska et al., Mutants in the Exo I motif of Escherichia coli dnaQ: defective proofreading and inviability due to error catastrophe. Proc Natl Acad Sci U S A. Apr. 2, 1996;93(7):2856-61.

Fowlkes et al., Multipurpose vectors for peptide expression on the M13 viral surface. Biotechniques. Sep. 1992;13(3):422-8.

Frieberg et al., Error-prone DNA polymerases: novel structures and the benefits of infidelity. Cell. Oct. 5, 2001;107(1):9-12.

Fuchs et al., Targeting Recombinant Antibodies to the Surface of Escherichia coli: Fusion to a Peptidoglycan Associated Lipoprotein. Bio/Technology. 1991;9:1370-72.

Gaj et al., Expanding the scope of site-specific recombinases for genetic and metabolic engineering. Biotechnol Bioeng. Jan. 2014;111(1):1-15. doi: 10.1002/bit.25096. Epub Sep. 13, 2013.

Garrard et al., Fab assembly and enrichment in a monovalent phage display system. Biotechnology (N Y). Dec. 1991;9(12):1373-7.

Gibson et al., Enzymatic assembly of DNA molecules up to several hundred kilobases. Nat Methods. May 2009;6(5):343-5. Epub Apr. 12, 2009.

Gordley et al., Evolution of programmable zinc finger-recombinases with activity in human cells. J Mol Biol. Mar. 30, 2007;367(3):802-13. Epub Jan. 12, 2007.

Gram et al., In vitro selection and affinity maturation of antibodies from a naive combinatorial immunoglobulin library. Proc Natl Acad Sci U S A. Apr. 15, 1992;89(8):3576-80.

Hart et al., Directed Evolution to Investigate Steric Control of Enzymatic Oxidosqualene Cyclization. An Isoleucine-to-Valine Mutation in Cycloartenol Synthase Allows Lanosterol and Parkeol Biosynthesis. J Am Chem Soc. 1999;121:9887-88.

(56) References Cited

OTHER PUBLICATIONS

Hawkins et al., Selection of phage antibodies by binding affinity. Mimicking affinity maturation. J Mol Biol. Aug. 5, 1992;226(3):889-96.

Hay et al., Bacteriophage cloning and *Escherichia coli* expression of a human IgM Fab. Hum Antibodies Hybridomas. Apr. 1992;3(2):81-5.

Hoogenboom et al., Antibody phage display technology and its applications. Immunotechnology. Jun. 1998;4(1):1-20.

Hoogenboom et al., Multi-subunit proteins on the surface of filamentous phage: methodologies for displaying antibody (Fab) heavy and light chains. Nucleic Acids Res. Aug. 11, 1991;19(15):4133-7.

Hoogenboom et al., Natural and designer binding sites made by phage display technology. Immunol Today. Aug. 2000;21 (8):371-8.

Houshmand et al., Use of Bateriophage T7 Displayed Peptides for Determination of Monoclonal Anitbody Specificity and Biosensor Analysis of the Binding Reaction. Anal Biochem. 1999;268:363-70.

Hu et al., *Escherichia coli* one- and two-hybrid systems for the analysis and identification of protein-protein interactions. Methods. Jan. 2000;20(1):80-94.

Hubbard et al., Continuous directed evolution of DNA-binding proteins to improve TALEN specificity. Nat Methods. Oct. 2015;12(10):939-42. doi: 10.1038/nmeth.3515. Epub Aug. 10, 2015. With Supplementary Information.

Huse et al., Generation of a large combinatorial library of the immunoglobulin repertoire in phage lambda. Science. Dec. 8, 1989;246(4935):1275-81.

Husimi et al., Cellstat—a continuous culture system of a bacteriophage for the study of the mutation rate and the selection process of the DNA level. Rev Sci Instrum. Apr. 1982;53(4):517-22.

Husimi, Selection and evolution of bacteriophages in cellstat. Adv Biophys. 1989;25:1-43.

Ichetovkin et al., Substrate recognition by the leucyl/phenylalanyl-tRNA-protein transferase. Conservation within the enzyme family and localization to the trypsin-resistant domain. J Biol Chem. Dec. 26, 1997;272(52):33009-14.

Ikeda et al., In vivo and in vitro activities of point mutants of the bacteriophage T7 RNA polymerase promoter. Biochemistry. Sep. 22, 1992;31(37):9073-80.

Ikeda et al., Selection and characterization of a mutant T7 RNA polymerase that recognizes an expanded range of T7 promoter-like sequences. Biochemistry. Sep. 7, 1993;32(35):9115-24.

Imburgio et al., Studies of promoter recognition and start site selection by T7 RNA polymerase using a comprehensive collection of promoter variants. Biochemistry. Aug. 29, 2000;39(34):10419-30.

International Preliminary Report on Patentability for PCT/US2016/027795, dated Oct. 26, 2017.

International Preliminary Report on Patentability for PCT/US2009/056194 dated Mar. 17, 2011.

International Preliminary Report on Patentability for PCT/US2011/066747, dated Jul. 4, 2013.

International Preliminary Report on Patentability for PCT/US2015/012022, dated Aug. 4, 2016.

International Preliminary Reporton Patentability for PCT/US2015/057012, dated May 4, 2017.

International Search Report and Written Opinion for PCT/US/2016/043559, dated Mar. 10, 2017.

International Search Report and Written Opinion for PCT/US2009/056194 dated Jun. 21, 2010.

International Search Report and Written Opinion for PCT/US2011/066747, dated Oct. 30, 2012.

International Search Report and Written Opinion for PCT/US2015/012022, dated Sep. 25, 2015.

International Search Report and Written Opinion for PCT/US2015/057012, dated Jun. 10, 2016.

International Search Report and Written Opinion for PCT/US2016/027795, dated Aug. 11, 2016.

International Search Report and Written Opinion for PCT/US2016/043513, dated Nov. 30, 2016.

International Search Report and Written Opinion for PCT/US2016/044546, dated Dec. 28, 2016.

Invitation to Pay Additional Fees for PCT/US/2016/043559, dated Jan. 12, 2017.

Invitation to Pay Additional Fees for PCT/US2011/066747, dated Aug. 30, 2012.

Invitation to Pay Additional Fees for PCT/US2016/044546, dated Oct. 12, 2016.

Irion et al., Identification and targeting of the ROSA26 locus in human embryonic stem cells. Nat Biotechnol. Dec. 2007;25(12):1477-82. Epub Nov. 25, 2007.

Johns et al., The promise and peril of continuous in vitro evolution. J Mol Evol. Aug. 2005;61 (2):253-63. Epub Jun. 27, 2005.

Joho et al., Identification of a region of the bacteriophage T3 and T7 RNA polymerases that determines promoter specificity. J Mol Biol. Sep. 5, 1990;215(1):31-9.

Joung et al., A bacterial two-hybrid selection system for studying protein-DNA and protein-protein interactions. Proc Natl Acad Sci U S A. Jun. 20, 2000;97(13):7382-7.

Karpinsky et al., Directed evolution of a recombinase that excises the provirus of most HIV-1 primary isolates with high specificity. Nat Biotechnol. Apr. 2016;34(4):401-9. doi: 10.1038/nbt.3467. Epub Feb. 22, 2016.

Kawarasaki et al., Enhanced crossover SCRATCHY: construction and high-throughput screening of a combinatorial library containing multiple non-homologous crossovers. Nucleic Acids Res. Nov. 1, 2003;31(21):e126.

Khlebnikov et al., Modulation of gene expression from the arabinose-inducible araBAD promoter. J Ind Microbiol Biotechnol. Jul. 2002;29(1):34-7.

Klement et al., Discrimination between bacteriophage T3 and T7 promoters by the T3 and T7 RNA polymerases depends primarily upon a three base-pair region located 10 to 12 base-pairs upstream from the start site. J Mol Biol. Sep. 5, 1990;215(1):21-9.

Kozak et al., Structural features in eukaryotic mRNAs that modulate the initiation of translation. J Biol Chem. Oct. 25, 1991;266(30):19867-70.

Kuzmine et al., Binding of the priming nucleotide in the initiation of transcription by T7 RNA polymerase. J Biol Chem. Jan. 31, 2003;278(5):2819-23. Epub Nov. 9, 2002.

Latimer et al., Specificity of monoclonal antibodies produced against phosphorothioate and ribo modified DNAs. Mol Immunol. Oct. 1995;32(14-15):1057-64.

Leconte et al., A population-based experimental model for protein evolution: effects of mutation rate and selection stringency on evolutionary outcomes. Biochemistry. Feb. 26, 2013; 52(8): 1490-1499.

Lincoln et al., Self-sustained replication of an RNA enzyme. Science. Feb. 27, 2009;323(5918):1229-32. Epub Jan. 8, 2009.

Lindemann et al., Evolution of bacteriophage in continuous culture: a model system to test antiviral gene therapies for the emergence of phage escape mutants. J Virol. Jun. 2002;76(11):5784-92.

Lutz et al., Creating multiple-crossover DNA libraries independent of sequence identity. Proc Natl Acad Sci U S A. Sep. 25, 2001;98(20):11248-53. Epub Sep. 18, 2001.

Makeyev et al., Evolutionary potential of an RNA virus. J Virol. Feb. 2004;78(4):2114-20.

Malmborg et al., Selective phage infection mediated by epitope expression on F pilus. J Mol Biol. Oct. 31, 1997;273(3):544-51.

Martin et al., Kinetic analysis of T7 RNA polymerase-promoter interactions with small synthetic promoters. Biochemistry. May 19, 1987;26(10):2690-6.

McCafferty et al., Phage antibodies: filamentous phage displaying antibody variable domains. Nature. Dec. 6, 1990;348(6301):552-4.

McConnell et al., Constrained peptide libraries as a tool for finding mimotopes. Gene. Dec. 30, 1994;151(1-2):115-8.

Milligan et al., Oligoribonucleotide synthesis using T7 RNA polymerase and synthetic DNA templates. Nucleic Acids Res. Nov. 11, 1987;15(21):8783-98.

Mills et al., An extracellular Darwinian experiment with a self-duplicating nucleic acid molecule. Proc Natl Acad Sci U S A. Jul. 1967;58(1):217-24.

(56) References Cited

OTHER PUBLICATIONS

Nelson et al., Filamentous phage DNA cloning vectors: a noninfective mutant with a nonpolar deletion in gene III. Virology. Jan. 30, 1981;108(2):338-50.
Nern et al., Multiple new site-specific recombinases for use in manipulating animal genomes. Proc Natl Acad Sci U S A. Aug. 23, 2011;108(34):14198-203. doi: 10.1073/pnas.1111704108. Epub Aug. 9, 2011.
O'Maille et al., Structure-based combinatorial protein engineering (SCOPE). J Mol Biol. Aug. 23, 2002;321(4):677-91.
Opperman et al., A model for a umuDC-dependent prokaryotic DNA damage checkpoint. Proc Natl Acad Sci U S A. Aug. 3, 1999;96(16):9218-23.
Ostendorf et al., Characterization of a dam mutant of Serratia marcescens and nucleotide sequence of the dam region. J Bacteriol. Jul. 1999;181(13):3880-5.
Ostermeier e al., A combinatorial approach to hybrid enzymes independent of DNA homology. Nat Biotechnol. Dec. 1999;17(12):1205-9.
Peyrottes et al., Oligodeoxynucleoside phosphoramidates (P-NH2): synthesis and thermal stability of duplexes with DNA and RNA targets. Nucleic Acids Res. May 15, 1996;24(10):1841-8.
Pu et al., Evolution of a split RNA polymerase as a versatile biosensor platform. Nat Chem Biol. Apr. 2017;13(4):432-438. doi: 10.1038/nchembio.2299. Epub Feb. 13, 2017.
Rakonjac et al., Filamentous phage are released from the bacterial membrane by a two-step mechanism involving a short C-terminal fragment of pill. J Mol Biol. Jun. 25, 1999;289(5):1253-65.
Rakonjac et al., Filamentous phage infection-mediated gene expression: construction and propagation of the gIII deletion mutant helper phage R408d3. Gene. Oct. 1, 1997;198(1-2):99-103.
Rakonjac et al., Roles of pIII in filamentous phage assembly. J Mol Biol. Sep. 11, 1998;282(1):25-41.
Raskin et al., Substitution of a single bacteriophage T3 residue in bacteriophage T7 RNA polymerase at position 748 results in a switch in promoter specificity. J Mol Biol. Nov. 20, 1992;228(2):506-15.
Raskin et al., T7 RNA polymerase mutants with altered promoter specificities. Proc Natl Acad Sci U S A. Apr. 15, 1993;90(8):3147-51.
Rebar et al., Phage display methods for selecting zinc finger proteins with novel DNA-binding specificities. Methods Enzymol. 1996;267:129-49.
Reidhaar-Olson et al., Random mutagenesis of protein sequences using oligonucleotide cassettes. Methods Enzymol. 1991;208:564-86.
Reuven et al., Lesion bypass by the *Escherichia coli* DNA polymerase V requires assembly of a RecA nucleoprotein filament. J Biol Chem. Feb. 23, 2001;276(8):5511-7. Epub Nov. 17, 2000.
Riechmann et al., The C-terminal domain of TolA is the coreceptor for filamentous phage infection of *E. coli*. Cell. Jul. 25, 1997;90(2):351-60.
Ringquist et al., Translation initiation in Escherichia coli: sequences within the ribosome-binding site. Mol Microbiol. May 1992;6(9):1219-29.
Rosenberg et al., T7 Select® Phage Display System: A Powerful new protein display system based on bacteriophage T7. Innovations. 1996;6:1-6.
Santini et al., Efficient display of an HCV cDNA expression library as C-terminal fusion to the capsid protein D of bacteriophage lambda. J Mol Biol. Sep. 11, 1998;282(1):125-35.
Santoro et al., Directed evolution of the site specificity of Cre recombinase. Proc Natl Acad Sci U S A. Apr. 2, 2002;99(7):4185-90. Epub Mar. 19, 2002.
Schultz et al., Oligo-2'-fluoro-2'-deoxynucleotide N3'-->P5' phosphoramidates: synthesis and properties. Nucleic Acids Res. Aug. 1, 1996;24(15):2966-73.
Scott et al., Searching for peptide ligands with an epitope library. Science. Jul. 27, 1990;249(4967):386-90.
Sices et al., A genetic screen for the isolation and characterization of site-specific proteases. Proc Natl Acad Sci U S A. Mar. 17, 1998;95(6):2828-33.
Sices et al., Rapid genetic selection of inhibitor-resistant protease mutants: clinically relevant and novel mutants of the HIV protease. AIDS Res Hum Retroviruses. Sep. 1, 2001;17(13):1249-55.
Sieber et al., Libraries of hybrid proteins from distantly related sequences. Nat Biotechnol. May 2001;19(5):456-60.
Silva et al., Selective disruption of the DNA polymerase III α-β complex by the umuD gene products. Nucleic Acids Res. Jul. 2012;40(12):5511-22. doi: 10.1093/nar/gks229. Epub Mar. 9, 2012.
Smith, Filamentous fusion phage: novel expression vectors that display cloned antigens on the virion surface. Science. Jun. 14, 1985;228(4705):1315-7.
Stemmer, Rapid evolution of a protein in vitro by DNA shuffling. Nature. Aug. 4, 1994;370(6488):389-91.
Sutter et al., Non-replicating vaccinia vector efficiently expresses bacteriophage T7 RNA polymerase. FEBS Lett. Aug. 28, 1995;371(1):9-12.
Torres et al., Non-integrative lentivirus drives high-frequency cre-mediated cassette exchange in human cells. PLoS One. 2011;6(5):e19794. doi: 10.1371/journal.pone.0019794. Epub May 23, 2011.
Tracewell et al., Directed enzyme evolution: climbing fitness peaks one amino acid at a time. Curr Opin Chem Biol. Feb. 2009;13(1):3-9. doi: 10.1016/j.cbpa.2009.01.017. Epub Feb. 25, 2009.
Tsuji et al., Random multi-recombinant PCR for the construction of combinatorial protein libraries. Nucleic Acids Res. Oct. 15, 2001;29(20):E97.
Tzagoloff et al., The Initial Steps In Infection With Coliphage M13. Virology. Nov. 1964;24:372-80.
Vidal et al., Yeast forward and reverse 'n'-hybrid systems. Nucleic Acids Res. Feb. 15, 1999;27(4):919-29.
Vidal-Aroca et al., One-step high-throughput assay for quantitative detection of betagalactosidase activity in intact gram-negative bacteria, yeast, and mammalian cells. Biotechniques. Apr. 2006;40(4):433-4, 436, 438 passim.
Voigt et al., Rational evolutionary design: the theory of in vitro protein evolution. Adv Protein Chem. 2000;55:79-160.
Voytek et al., Emergence of a fast-reacting ribozyme that is capable of undergoing continuous evolution. Proc Natl Acad Sci USA. Sep. 25, 2007;104(39):15288-93. Epub Sep. 18, 2007.
Wang et al., Evolution of new nonantibody proteins via iterative somatic hypermutation. Proc Natl Acad Sci USA. Nov. 30, 2004;101 (48): 16745-9. Epub Nov. 19, 2004.
Wang et al., Programming cells by multiplex genome engineering and accelerated evolution. Nature. Aug. 13, 2009;460(7257):894-8. Epub Jul. 26, 2009.
Wharton et al., A new-specificity mutant of 434 repressor that defines an amino acid-base pair contact. Nature. Apr. 30-May 6, 1987;326(6116):888-91.
Wharton et al., Changing the binding specificity of a repressor by redesigning an alpha-helix. Nature. Aug. 15-21, 1985;316(6029):601-5.
Wright et al., Continuous in vitro evolution of catalytic function. Science. Apr. 25, 1997;276(5312):614-7.
Yuan et al., Laboratory-directed protein evolution. Microbiol Mol Biol Rev. Sep. 2005;69(3):373-92.
Zhou et al., Optimization of the Tet-On system for regulated gene expression through viral evolution. Gene Ther. Oct. 2006;13(19):1382-90. Epub May 25, 2006.
International Preliminary Report on Patentability, dated Dec. 24, 2020, in connection with Application No. PCT/US2019/037216.
Partial European Search Report for Application No. 18847527.1, dated Apr. 21, 2021.
Invitation to Pay Additional Fees, dated Oct. 13, 2020, in connection with Application No. PCT/US2020/042016.
International Search Report and Written Opinion, dated Dec. 10, 2020, in connection with Application No. PCT/US2020/042016.
[No Author Listed] Genbank Submission. NCBI; Accession No. WP_010869888, version WP_010869888.1. tyrosine—tRNA ligase [Methanocaldococcus jannaschii], Jun. 1, 2019.

(56) References Cited

OTHER PUBLICATIONS

Genbank Submission. NCBI; Accession No. WP_011033391, version WP_011033391.1. pyrrolysine—tRNA(Pyl) ligase [Methanosarcina mazei]. Polycarpo et al.; Nov. 29, 2019.
Genbank Submission. NCBI; Accession No. WP_011305865, version WP_011305865.1. pyrrolysine—tRNA(Pyl) ligase [Methanosarcina barkeri].Polycarpo et al.; Nov. 29, 2019.
Amiram et al., Evolution of translation machinery in recoded bacteria enables multi-site incorporation of nonstandard amino acids. Nat Biotechnol. Dec. 2015;33(12):1272-1279. doi: 10.1038/nbt.3372. Epub Nov. 16, 2015.
Blum, Continuous evolution of bacterial neurotoxins for intracellular protease therapy. 2019. Harvard University. Poster. 1 page.
Blum, Generation of selective botulinum neurotoxin proteases with reprogrammed substrate specificity through phage-assisted directed evolution. Jun. 4, 2019. Harvard University. Powerpoint. 24 pages.
Blum, Generation of selective botulinum neurotoxin proteases with reprogrammed substrate specificity through phage-assisted directed evolution. Harvard University. Apr. 7, 2020. Powerpoint. 36 pages.
Blum et al., Phage-assisted evolution of botulinum neurotoxin proteases with reprogrammed specificity. Science. Feb. 19, 2021;371(6531):803-810. doi: 10.1126/science.abf5972.
Chylinski et al., The tracrRNA and Cas9 families of type II CRISPR-Cas immunity systems. RNA Biol. May 2013;10(5):726-37. doi: 10.4161/rna.24321. Epub Apr. 5, 2013.
Cong et al., Multiplex genome engineering using CRISPR/Cas systems. Science. 2013; 339: 819-23.
Deltcheva et al., CRISPR RNA maturation by trans-encoded small RNA and host factor RNase III. Nature. Mar. 31, 2011;471(7340):602-7. doi: 10.1038/nature09886.
DiCarlo et al., Genome engineering in *Saccharomyces cerevisiae* using CRISPR-Cas systems. Nucleic Acids Res. Apr. 2013;41(7):4336-43. doi: 10.1093/nar/gkt135. Epub Mar. 4, 2013.
Fan et al., Rationally evolving tRNAPyl for efficient incorporation of noncanonical amino acids. Nucleic Acids Res. Dec. 15, 2015;43(22):e156. doi: 10.1093/nar/gkv800. Epub Aug. 6, 2015.
Ferretti et al., Complete genome sequence of an M1 strain of *Streptococcus pyogenes*. Proc Natl Acad Sci U S A. Apr. 10, 2001;98(8):4658-63. doi: 10.1073/pnas.071559398.
Greener et al., An efficient random mutagenesis technique using an *E. coli* mutator strain. Methods Mol Biol. 1996;57:375-85.
Griffiths et al., Human anti-self-antibodies with high specificity from phage display libraries. EMBO J. Feb. 1993;12(2):725-34.
Guilinger et al., Fusion of catalytically inactive Cas9 to FokI nuclease improves the specificity of genome modification. Nat. Biotechnol. 2014; 32(6): 577-82. doi: 10.1038/nbt.2909. Epub Apr. 25, 2014.
Guo et al., Evolution of amber suppressor tRNAs for efficient bacterial production of proteins containing nonnatural amino acids. Angew Chem Int Ed Engl. 2009;48(48):9148-51. doi: 10.1002/anie.200904035.
Guo et al., Polyspecific pyrrolysyl-tRNA synthetases from directed evolution. Proc Natl Acad Sci U S A. Nov. 25, 2014;111(47):16724-9. doi: 10.1073/pnas.1419737111. Epub Nov. 10, 2014.
Herring et al., The amino-terminal domain of pyrrolysyl-tRNA synthetase is dispensable in vitro but required for in vivo activity. FEBS Lett. Jul. 10, 2007;581(17):3197-203. doi: 10.1016/j.febslet.2007.06.004. Epub Jun. 12, 2007.
Hwang et al., Efficient genome editing in zebrafish using a CRISPR-Cas system. Nat Biotechnol. Mar. 2013;31(3):227-9. doi: 10.1038/nbt.2501. Epub Jan. 29, 2013.
Jankovic et al., Direct selection and phage display of a Gram-positive secretome. Genome Biology. Dec. 13, 2007; 8(266): 1-15.
Jiang et al., PylSn and the homologous N-terminal domain of pyrrolysyl-tRNA synthetase bind the tRNA that is essential for the genetic encoding of pyrrolysine. J Biol Chem. Sep. 21, 2012;287(39):32738-46. doi: 10.1074/jbc.M112.396754. Epub Jul. 31, 2012.
Jiang et al., RNA guided editing of bacterial genomes using CRISPR-Cas systems. Nat Biotechnol. Mar. 2013;31(3):233-9. doi: 10.1038/nbt.2508. Epub Jan. 29, 2013.
Jinek et al., A programmable dual-RNA-guided DNA endonuclease in adaptive bacterial immunity. Science. Aug. 17, 2012;337(6096):816-21. doi: 10.1126/science.1225829. Epub Jun. 28, 2012.
Jinek et al., RNA-programmed genome editing in human cells. Elife. Jan. 29, 2013;2:e00471. doi: 10.7554/eLife.00471.
Kasai et al., Distinct initial SNARE configurations underlying the diversity of exocytosis. Physiol Rev. Oct. 2012;92(4):1915-64. doi: 10.1152/physrev.00007.2012.
Kavran et al., Structure of pyrrolysyl-tRNA synthetase, an archaeal enzyme for genetic code innovation. Proc Natl Acad Sci U S A. Jul. 3, 2007; 104(27): 11268-73. doi: 10.1073/pnas.0704769104. Epub Jun. 25, 2007.
Liu et al., PTEN deletion enhances the regenerative ability of adult corticospinal neurons. Nat Neurosci. Sep. 2010;13(9):1075-81. doi: 10.1038/nn.2603. Epub Aug. 8, 2010.
Lundquist et al., Site-directed mutagenesis and characterization of uracil-DNA glycosylase inhibitor protein. Role of specific carboxylic amino acids in complex formation with *Escherichia coli* uracil-DNA glycosylase. J Biol Chem. Aug. 22, 1997;272(34):21408-19. doi: 10.1074/jbc.272.34.21408.
Mali et al., RNA-guided human genome engineering via Cas9. Science. 2013; 339:823-26.
Marcet-Palacios et al., Vesicle-associated membrane protein 7 (VAMP-7) is essential for target cell killing in a natural killer cell line. Biochem Biophys Res Commun. Feb. 15, 2008;366(3):617-23. doi: 10.1016/j.bbrc.2007.11.079. Epub Nov. 26, 2007.
Meng et al., Role of SNARE proteins in tumourigenesis and their potential as targets for novel anti-cancer therapeutics. Biochim Biophys Acta. Aug. 2015;1856(1):1-12. doi: 10.1016/j.bbcan.2015.04.002. Epub May 5, 2015.
Nicholson-Fish et al., VAMP4 Is an Essential Cargo Molecule for Activity-Dependent Bulk Endocytosis. Neuron. Dec. 2, 2015;88(5):973-984. doi: 10.1016/j.neuron.2015.10.043. Epub Nov. 19, 2015.
Nozawa et al., Pyrrolysyl-tRNA synthetase-tRNA(Pyl) structure reveals the molecular basis of orthogonality. Nature. Feb. 26, 2009;457(7233): 1163-7. doi: 10.1038/nature07611. Epub Dec. 31, 2008.
O'Donoghue et al., Upgrading protein synthesis for synthetic biology. Nat Chem Biol. Oct. 2013;9(10):594-8. doi: 10.1038/nchembio.1339.
Raingo et al., VAMP4 directs synaptic vesicles to a pool that selectively maintains asynchronous neurotransmission. Nat Neurosci. Mar. 11, 2012;15(5):738-45. doi: 10.1038/nn.3067.
Ruiz-Martinez et al., YKT6 expression, exosome release, and survival in non-small cell lung cancer. Oncotarget. Aug. 9, 2016;7(32):51515-51524. doi: 10.18632/oncotarget.9862.
Putnam et al., Protein mimicry of DNA from crystal structures of the uracil-DNA glycosylase inhibitor protein and its complex with *Escherichia coli* uracil-DNA glycosylase. J Mol Biol. Mar. 26, 1999;287(2):331-46. doi: 10.1006/jmbi.1999.2605.
Turner et al., Structural plasticity of an aminoacyl-tRNA synthetase active site. Proc Natl Acad Sci U S A. Apr. 25, 2006;103(17):6483-8. doi: 10.1073/pnas.0601756103. Epub Apr. 17, 2006.
Umehara et al., N-acetyl lysyl-tRNA synthetases evolved by a CcdB-based selection possess N-acetyl lysine specificity in vitro and in vivo. FEBS Lett. Mar. 23, 2012;586(6):729-33. doi: 10.1016/j.febslet.2012.01.029. Epub Jan. 28, 2012.
Yanagisawa et al., Crystallographic studies on multiple conformational states of active-site loops in pyrrolysyl-tRNA synthetase. J Mol Biol. May 2, 2008;378(3):634-52. doi: 10.1016/j.jmb.2008.02.045. Epub Feb. 29, 2008.
Yanagisawa et al., Multistep engineering of pyrrolysyl-tRNA synthetase to genetically encode N(epsilon)-(o-azidobenzyloxycarbonyl) lysine for site-specific protein modification. Chem Biol. Nov. 24, 2008;15(11): 1187-97. doi: 10.1016/j.chembiol.2008.10.004.
Zhang et al., Identification and characterization of a novel botulinum neurotoxin. Nat Commun. Aug. 3, 2017;8:14130. doi: 10.1038/ncomms14130.

\* cited by examiner

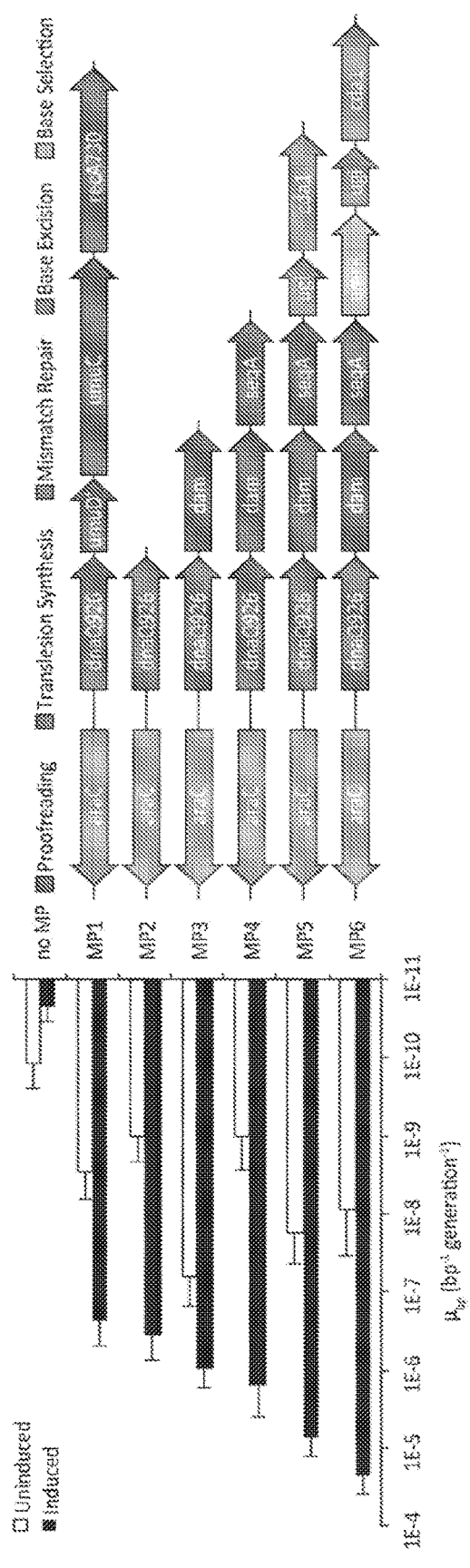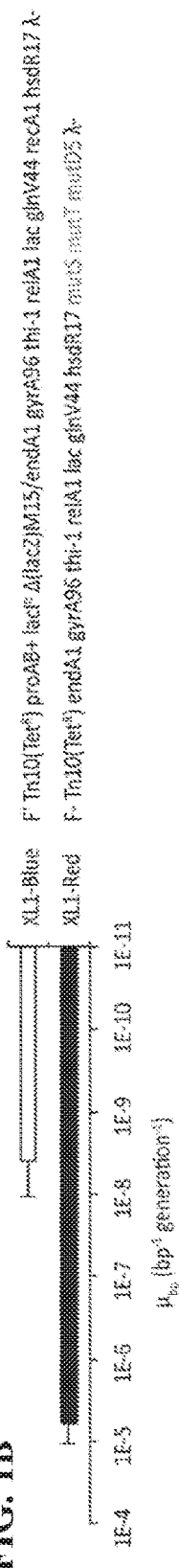

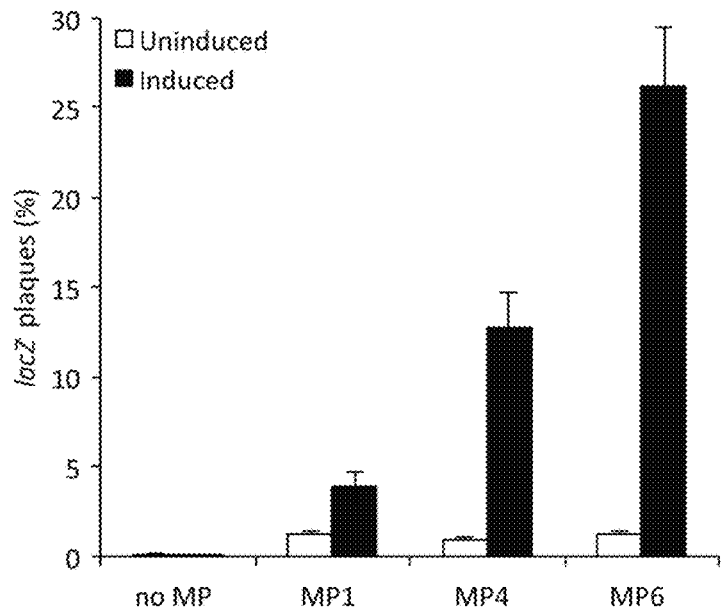
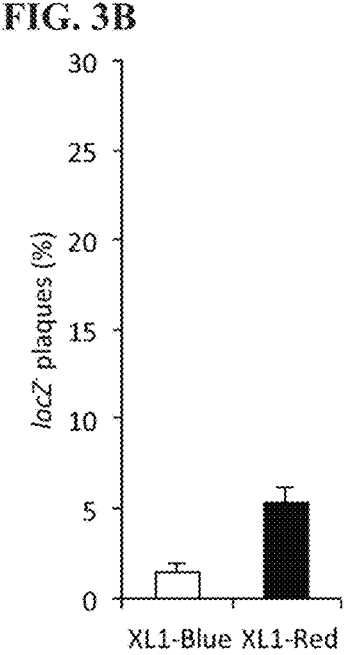
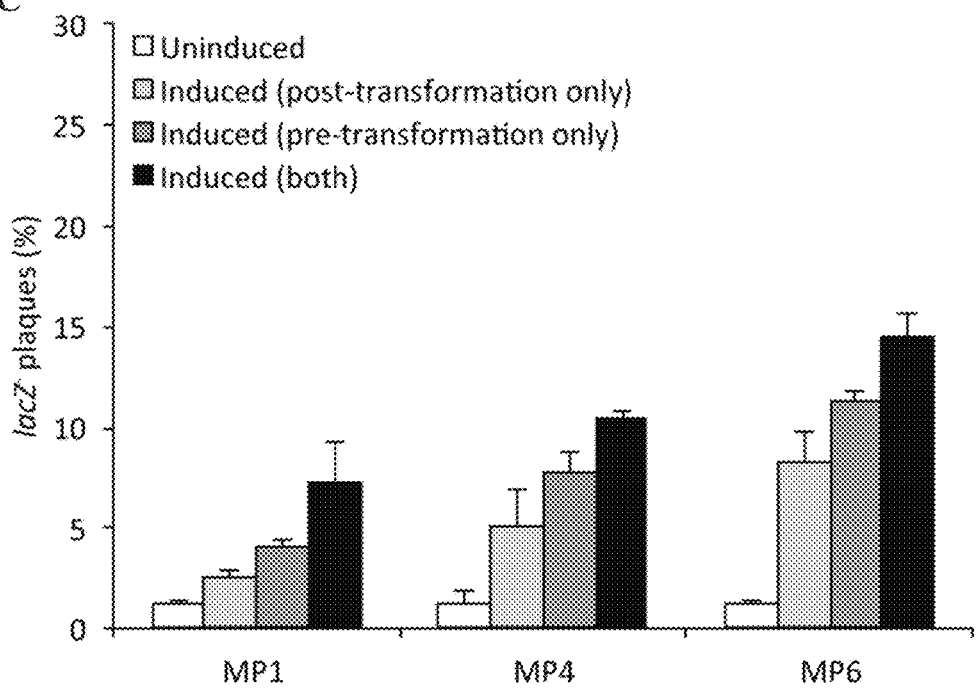

MP1 (n=197)

MP4 (n=196)

MP6 (n=215)

XL1-Red (n=80)*

Phage *lacZ* mutagenesis

MP1 (n=65589)

MP4 (n=111974)

MP6 (n=112580)

XL1-Red (n=5250)

LF-Pol I (*in vivo*)

mutA (*in vivo*)

Mutazyme II (*in vitro*)

EMS (*in vitro*)

US 11,299,729 B2

VECTOR-BASED MUTAGENESIS SYSTEM

RELATED APPLICATIONS

The present application is a national stage filing under 35 U.S.C. § 371 of the international PCT application, PCT/US2016/027795, filed Apr. 15, 2016, which claims the benefit under 35 U.S.C. § 119(e) to U.S. provisional patent applications, U.S. Ser. No. 62/149,378, filed Apr. 17, 2015, and U.S. Ser. No. 62/272,035, filed Dec. 28, 2015 the entire contents of each of which are incorporated herein by reference.

GOVERNMENT SUPPORT

This invention was made with government support under grant number HR0011-11-2-0003, awarded by Defense Advanced Research Projects Agency (DARPA), and under grant number N66001-12-C-4207 awarded by the Space and Naval Warfare Systems Command (SPAWAR). The government has certain rights in the invention.

BACKGROUND OF THE INVENTION

The random mutagenesis of DNA provides the genetic diversity that fuels evolution both in nature and the laboratory. Methods to enhance unbiased, random mutagenesis in cells offer major advantages over in vitro mutagenesis, but current in vivo methods suffer from a lack of control, genomic instability, low efficiency, and narrow mutational spectra.

SUMMARY OF THE INVENTION

Some aspects of this disclosure provide strategies, reagents, compositions (e.g., vectors), kits, methods, and systems for modulating the mutation rate in cells. The strategies, reagents, compositions, kits, methods, and systems are broadly applicable for the modulation of mutation rates in cells in any context in which high mutation rates and/or control over a broad range of mutation rates is desired, for example, in the context of diversifying a nucleic acid sequence or a plurality of such sequences within a population of cells, for the generation of diversified nucleic acid libraries, and for directed evolution of nucleic acids and encoded products. While some uses and applications are described in detail herein, additional suitable uses of the strategies, reagents, compositions, kits, methods, and systems provided herein will be apparent to those of skill in the art based on the present disclosure.

Phage-assisted continuous evolution (PACE) can serve as a rapid, high-throughput method to evolve genes of interest. One advantage of the PACE technology is that both the time and human effort required to evolve a gene of interest are dramatically decreased as compared to conventional iterative evolution methods. The general concept of PACE technology has been described, for example, in International PCT Application, PCT/US2009/056194, filed Sep. 8, 2009, published as WO 2010/028347 on Mar. 11, 2010; International PCT Application, PCT/US2011/066747, filed Dec. 22, 2011, published as WO 2012/088381 on Jun. 28, 2012; U.S. Application, U.S. Ser. No. 13/922,812, filed Jun. 20, 2013; and U.S. Application, U.S. Ser. No. 62/067,194, filed Oct. 22, 2014, the entire contents of each of which are incorporated herein by reference. During PACE, a phage vector carrying a gene encoding a gene of interest replicates in a flow of host cells through a fixed-volume vessel (a "lagoon"). For example, in some embodiments of PACE described herein, a population of bacteriophage vectors replicates in a continuous flow of bacterial host cells through the lagoon, wherein the flow rate of the host cells is adjusted so that the average time a host cell remains in the lagoon is shorter than the average time required for host cell division, but longer than the average life cycle of the vector, e.g., shorter than the average M13 bacteriophage life cycle. As a result, the population of vectors replicating in the lagoon can be varied by inducing mutations, and then enriching the population for desired variants by applying selective pressure, while the host cells do not effectively replicate in the lagoon.

The rate at which host cells mutate a gene of interest during a directed evolution experiment can affect the time required to evolve a gene of interest to a desired state, and may even limit the mutations that can be achieved during a standard PACE experiment. While conventional methods of mutagenesis are effective, in some circumstances, higher mutation rates are desirable. Some aspects of this disclosure provide potent, inducible, broad-spectrum, and expression construct-based (vector-based) mutagenesis systems for use in bacterial cells, e.g., E. coli cells. These recombinant expression constructs, also referred to as mutagenesis constructs or, if they are in the form of a plasmid, as mutagenesis plasmids, can enhance mutation rates by over 300,000-fold as compared to basal levels when fully induced, surpassing the mutational efficiency and spectra of the most widely used in vivo and in vitro mutagenesis methods. In some embodiments, the mutation rate can be modulated via inducible expression of mutagenic gene products from the expression constructs provided herein, which are useful for modulating the mutation rates as desired, e.g., during different phases of a directed evolution experiment.

Some aspects of this disclosure demonstrate the usefulness of the mutagenesis systems provided herein in a directed evolution context, e.g., for evolving biomolecules with novel or changed properties. The improved mutation rates are demonstrated, for example, by the data provided in the Examples, showing that novel antibiotic resistance can be evolved in wild-type E. coli in less than 24 hour using the mutagenesis expression constructs, thus outperforming all known methods for inducing mutations in host cells, including, for example, chemical mutagens, UV light, and the mutator strain XL1-Red under similar conditions. The mutagenesis systems provided herein also allowed for the rapid continuous evolution of T7 RNA polymerase variants capable of initiating transcription using the T3 promoter in less than 10 hours without requiring any evolutionary stepping-stones or initial mutational drift, in contrast to previously described mutagenesis systems with lower mutation rates. The mutagenesis systems, methods, and kits provided herein can be applied, for example, to the high-frequency, broad-spectrum mutagenesis of chromosomal, episomal, and viral nucleic acids in vivo, and are applicable, inter alia, to a variety of cells, e.g., bacterial, yeast, and eukaryotic cells, and a variety of applications, e.g., both bacterial or bacteriophage-mediated laboratory evolution platforms. Those of skill in the art will understand that these examples are provided to illustrate some non-limiting, possible applications of the mutagenesis systems and expression constructs provided herein, and that the present disclosure embraces additional applications and is not limit in this respect.

In some embodiments, a plurality of nucleic acid sequences encoding a gene product that increases the mutation rate in a cell are employed, e.g., combinations of such gene products as shown in Table 2 or FIG. 7. In some embodiments, combinations of two or more nucleic acid sequences encoding different gene products that increases the mutation rate in a cell may be included in a single expression construct, e.g., in a multi-cistronic construct in which a single promoter, e.g., an inducible promoter as described herein, drives expression of all or a plurality of the different encoding sequences, or in an expression construct comprising two or more promoters, each driving expression of at least one of the encoding sequences. In some embodiments, a combination of different encoding sequences may be provided on different expression constructs, each of which carrying at least one of the different encoding sequences. Suitable configurations or monocistronic, multicistronic, and multi-vector expression constructs for expression of the combinations of mutagenesis-inducing gene products in cells will be apparent to those of skill in the art in view of the present disclosure.

In some embodiments, the gene product that disrupts a proof-reading pathway is a dnaQ926, BRM1, BR11, BR1, BR6, or BR13 gene product. In some embodiments, the gene product that disrupts a translesion synthesis pathway is an umuD', umuC, recA, dinB, or polB gene product.

In some embodiments, the gene product that disrupts a translesion synthesis pathway is an umuD', umuC, recA, dinB, or polB gene product. In some embodiments, the recA gene product is a recA730 gene product. In some embodiments, the polB gene product is a polB(D156A) gene product. In some embodiments, the gene product that disrupts a methyl-directed mismatch repair pathway is a mutS, mutL, mutH, dam, or seqA gene product. In some embodiments, the mutS gene product is a mutS538, mutS503, or mutSAN gene product. In some embodiments, the mutL gene product is a mutL705, mutL713, mutL(R261H), or mutL(K307A) gene product. In some embodiments, the mutH gene product is a mutH(E56A), mutH(K79E), or mutH(K116E) gene product. In some embodiments, the gene product that disrupts a base excision repair pathway is a ugi, AID, APOBEC, CDA, MAG, or AAG gene product. In some embodiments, the AID gene product is an AID(7), AID(7.3), AID(7.3.5), AID(7.3.3), AID(7.3.1), or AID (7.3.2) gene product. In some embodiments, the APOBEC gene product is an APOBEC 1 gene product. In some embodiments, the CDA gene product is a CDA1 gene product. In some embodiments, the MAG gene product is a MAG1 gene product. In some embodiments, the AAG gene product is an AAG(Y127I-H136L) or Δ80-AAG(Y127I-H136L) gene product.

In some embodiments, the gene product that disrupts a base selection pathway is a dnaE74, dnaE486, dnaE1026, dnaX36, dnaX2016, emrR, nrdAB, nrdA(H59A)B, nrdA(A65V)B, nrdA(A301V)B, nrdAB(P334L), or nrdEF gene product.

In some embodiments, the expression construct comprises a nucleic acid sequence encoding a rsmE, cchA, yffI, or yfjY gene product.

In some embodiments, the expression construct comprises a nucleic acid sequence encoding a dnaQ926 gene product. In some embodiments, the expression construct further comprises a nucleic acid sequence encoding a umuD', umuC, or recA730 gene product, or any combination thereof. In some embodiments, the expression construct further comprises a nucleic acid sequence encoding a dnaE486, dnaE1026, dnaX36, or dnaX2016 gene product, or any combination thereof. In some embodiments, the expression construct further comprises a nucleic acid sequence encoding a mutS538, mutS503, mutL705, mutL713, mutL (R261H), mutL(K307A), mutH(E56A), mutH(K79E), or mutH(K116E) gene product, or any combination thereof. In some embodiments, the expression construct further comprises a nucleic acid sequence encoding a Dam gene product. In some embodiments, the expression construct further comprises a nucleic acid sequence encoding a seqA gene product. In some embodiments, the expression construct further comprises a nucleic acid sequence encoding a emrR, mutH(E56A), mutL713, mutS503, mutSAN, dinB, or polB gene product, or any combination thereof.

In some embodiments, the expression construct comprises a nucleic acid sequence encoding a Dam gene product. In some embodiments, the expression construct further comprises a nucleic acid sequence encoding a seqA gene product. In some embodiments, the expression construct further comprises a nucleic acid sequence encoding a emrR gene product. In some embodiments, the expression construct further comprises a nucleic acid sequence encoding a ugi gene product. In some embodiments, the expression construct further comprises a nucleic acid sequence encoding an AID, AID(7), AID(7.3), AID(7.3.5), AID(7.3.3), AID(7.3.1), AID(7.3.2), APOBEC1, or CDA1 gene product, or any combination thereof. In some embodiments, the expression construct further comprises a nucleic acid sequence encoding a mutSAN gene product. In some embodiments, the expression construct further comprises a nucleic acid sequence encoding a rsmE, cchA, yffI, yfjY, nrdAB, nrdA (H59A)B, nrdA(A65V)B, nrdA(A301V)B, nrdEF, or nrdAB (P334L)gene product, or any combination thereof.

In some embodiments, the expression construct comprises a nucleic acid sequence encoding a dnaE74 gene product. In some embodiments, the expression construct comprises a nucleic acid sequence encoding a dnaE486 gene product. In some embodiments, the expression construct comprises a nucleic acid sequence encoding a dnaE1026 gene product. In some embodiments, the expression construct comprises a nucleic acid sequence encoding a dnaX36 gene product. In some embodiments, the expression construct comprises a nucleic acid sequence encoding a dnaX2016 gene product. In some embodiments, the expression construct comprises a nucleic acid sequence encoding a rpsD12 gene product. In some embodiments, the expression construct comprises a nucleic acid sequence encoding a rpsD14 gene product. In some embodiments, the expression construct comprises a nucleic acid sequence encoding a rpsD16 gene product. In some embodiments, the expression construct comprises a nucleic acid sequence encoding a polB gene product. In some embodiments, the expression construct comprises a nucleic acid sequence encoding a polB(D156A) gene product. In some embodiments, the expression construct comprises a nucleic acid sequence encoding a MAG1 gene product. In some embodiments, the expression construct comprises a nucleic acid sequence encoding a AAG(Y127I-H136L) gene product. In some embodiments, the expression construct comprises a nucleic acid sequence encoding a Δ80-AAG(Y127I-H136L) gene product.

In some embodiments, the expression construct is comprised in a plasmid. In some embodiments, the plasmid comprises a bacterial origin of replication. In some embodiments, the origin of replication is a cloDF13 origin of replication. In some embodiments, the plasmid comprises a nucleic acid sequence encoding a gene product conferring resistance to an antibiotic to a bacterial host cell. In some embodiments, the antibiotic is chloramphenicol, kanamycin, tetracycline, tetracycline, spectinomycin or apramycin, or ampicillin. Additional suitable origins of replication and antibiotics for use in embodiments of this disclosure will be apparent to those of skill in the art. The disclosure is not limited in this respect.

In some embodiments, the expression construct comprises at least one inducible promoter controlling the expression of at least one nucleic acid sequence encoding the gene product that disrupts a proofreading pathway, a translesion synthesis pathway, a methyl-directed mismatch repair pathway, a base excision repair pathway, or a base selection pathway, or any combination thereof. In some embodiments, the inducible prompter is an arabinose responsive promoter. In some embodiments, the arabinose responsive promoter is a $P_{BAD}$ promoter. In some embodiments, the expression construct comprises a nucleic acid sequence encoding an arabinose operon regulatory protein. In some embodiments, the arabinose operon regulatory protein is araC. In some embodiments, the nucleic acid sequence encoding the arabinose operon regulatory protein is under the control of a weak promoter. In some embodiments, the weak promoter is a $P_C$ promoter. Additional weak promoters will be apparent to those of skill in the art, and the present disclosure is not limited in this respect.

In some embodiments, the expression construct comprises at least one codon-optimized nucleic acid sequence encoding a gene product. In some embodiments, the codon-optimized nucleic acid sequence comprises at least one codon of a naturally-occurring sequence encoding the gene product that has been replaced with a different codon encoding the same amino acid. In some embodiments, the at least one codon replacing the codon of the naturally occurring nucleic acid sequence corresponds to a tRNA expressed in a bacterial host cell. In some embodiments, the expression construct comprises a nucleic acid sequence encoding a ribosome-binding site, and wherein at least one ribosome-binding site encoded by the expression construct is modified as compared to a naturally occurring ribosome binding site. In some embodiments, the modified ribosome binding site exhibits increased ribosome binding as compared to the naturally occurring ribosome binding site.

In some embodiments, the expression construct comprises a nucleic acid sequence encoding a gene product or a combination of such sequences listed in Table 2 or FIG. 7.

Some aspects of this disclosure provide plasmids, cosmids, or artificial chromosomes (e.g., bacterial artificial chromosome, yeast artificial chromosomes, etc.) comprising an expression construct as disclosed herein.

Some aspects of this disclosure provide a cell comprising an expression construct or a plasmid as provided herein. In some embodiments, the cell is a bacterial cell. In some embodiments, the cell further comprises a selection plasmid or an accessory plasmid. In some embodiments, the cell is a host cell for a bacteriophage. In some embodiments, the cell is an *E. coli* cell. In some embodiments, the cell is in a lagoon.

Some aspects of this disclosure provide methods for modulating the mutation rate in a cell, e.g., in a host cell for a bacteriophage. In some embodiments, the method comprises contacting the cell with an expression construct or a plasmid as disclosed herein. In some embodiments, the expression construct comprises an inducible promoter, and the method further comprises culturing the host cell under conditions suitable to induce expression from the inducible promoter. In some embodiments, the inducible promoter is an arabinose-inducible promoter, and culturing the host cell under conditions suitable to induce expression from the inducible promoter comprises contacting the host cell with an amount of arabinose sufficient to increase expression of the arabinose-inducible promoter by at least 10-fold, at least 50-fold, at least 100-fold, at least 500-fold, at least 1000-fold, at least 5000-fold, at least 10000-fold, at least 50000-fold, at least 100000-fold, at least 500000-fold, or at least 1000000-fold as compared to basal expression in the absence of arabinose. In some embodiments, the method results in an at least 10-fold, at least 100-fold, at least 1000-fold, at least 10000-fold, at least 15000-fold, at least 200000-fold, at least 250000-fold, or at least 300000-fold increased mutation rate as compared to the mutation rate in the host cell in the absence of the expression construct.

Some aspects of this disclosure provide methods for directed evolution using an expression construct provided herein. In some embodiments, the method comprises (a) contacting a population of host cells comprising a mutagenesis expression construct or plasmid as provided herein with a population of phage vectors comprising a gene to be evolved and deficient in at least one gene for the generation of infectious phage particles, wherein (1) the host cells are amenable to transfer of the vector; (2) the vector allows for expression of the gene to be evolved in the host cell, can be replicated by the host cell, and the replicated vector can transfer into a second host cell; (3) the host cell expresses a gene product encoded by the at least one gene for the generation of infectious phage particles of (a) in response to the activity of the gene to be evolved, and the level of gene product expression depends on the activity of the gene to be evolved; (b) incubating the population of host cells under conditions allowing for mutation of the gene to be evolved and the transfer of the vector comprising the gene to be evolved from host cell to host cell, wherein host cells are removed from the host cell population, and the population of host cells is replenished with fresh host cells that comprise the expression construct but do not harbor the vector; and (c) isolating a replicated vector from the host cell population in (b), wherein the replicated vector comprises a mutated version of the gene to be evolved.

In some embodiments, the expression construct comprises an inducible promoter, and the step of incubating (step (b)) comprises culturing the population of host cells under conditions suitable to induce expression from the inducible promoter. In some embodiments, the inducible promoter is an arabinose-inducible promoter, and the step of incubating (step (b)) comprises contacting the host cell with an amount of arabinose sufficient to increase expression of the arabinose-inducible promoter by at least 10-fold, at least 50-fold, at least 100-fold, at least 500-fold, at least 1000-fold, at least 5000-fold, at least 10000-fold, at least 50000-fold, at least 100000-fold, at least 500000-fold, or at least 1000000-fold as compared to basal expression in the absence of arabinose.

In some embodiments, the vector is a viral vector. In some embodiments, the viral vector is a phage. In some embodiments, the phage is a filamentous phage. In some embodiments, the phage is an M13 phage.

In some embodiments, the at least one gene for the generation of infectious phage particles comprises a sequence encoding a pIII protein. In some embodiments, the at least one gene for the generation of infectious phage particles comprises a full-length gIII gene. In some embodiments, the host cells comprise all phage genes except for the at least one gene for the generation of infectious phage particles in the form of a helper phage. In some embodiments, the phage genes comprised on the helper phage comprise pI, pII, pIV, pV, pVI, pVII, pVIII, pIX, pX, and/or pXI.

In some embodiments, the host cells comprise an accessory plasmid. In some embodiments, the accessory plasmid comprises an expression construct encoding the pIII protein under the control of a promoter that is activated by a gene product encoded by the gene to be evolved. In some embodiments, the host cells comprise the accessory plasmid, and together the helper phage and the accessory plasmid comprise all genes required for the generation of an infectious phage. In some embodiments, the method further comprises a negative selection for undesired activity of the gene to be evolved. In some embodiments, the host cells comprise an expression construct encoding a dominant-negative pIII protein (pIII-neg). In some embodiments, expression of the pIII-neg protein is driven by a promoter the activity of which depends on an undesired function of the gene to be evolved.

In some embodiments, step (b) comprises incubating the population of host cells for a time sufficient for at least 10, at least 20, at least 30, at least 40, at least 50, at least 100, at least 200, at least 300, at least 400, at least, 500, at least 600, at least 700, at least 800, at least 900, at least 1000, at least 1250, at least 1500, at least 1750, at least 2000, at least 2500, at least 3000, at least 4000, at least 5000, at least 7500, at least 10000, or more consecutive life cycles of the viral vector or phage. In some embodiments, the host cells are *E. coli* cells.

In some embodiments, the host cells are incubated in suspension culture. In some embodiments, the population of host cells is continuously replenished with fresh host cells that do not comprise the vector. In some embodiments, fresh cells are being replenished and cells are being removed from the cell population at a rate resulting in a substantially constant number of cells in the cell population. In some embodiments, fresh cells are being replenished and cells are being removed from the cell population at a rate resulting in a substantially constant vector population. In some embodiments, fresh cells are being replenished and cells are being removed from the cell population at a rate resulting in a substantially constant vector, viral, or phage load. In some embodiments, the rate of fresh cell replenishment and/or the rate of cell removal is adjusted based on quantifying the cells in the cell population. In some embodiments, the rate of fresh cell replenishment and/or the rate of cell removal is adjusted based on quantifying the frequency of host cells harboring the vector and/or of host cells not harboring the vector in the cell population. In some embodiments, the quantifying is by measuring the turbidity of the host cell culture, measuring the host cell density, measuring the wet weight of host cells per culture volume, or by measuring light extinction of the host cell culture.

In some embodiments, the host cells are not exposed to a mutagen other than the mutagenesis expression construct or constructs provided herein. In some embodiments, the host cells are exposed to a mutagen. In some embodiments, the mutagen is ionizing radiation, ultraviolet radiation, base analogs, deaminating agents (e.g., nitrous acid), intercalating agents (e.g., ethidium bromide), alkylating agents (e.g., ethylnitrosourea), transposons, bromine, azide salts, psoralen, benzene, 3-Chloro-4-(dichloromethyl)-5-hydroxy-2 (5H)-furanone (MX) (CAS no. 77439-76-0), O,O-dimethyl-S-(phthalimidomethyl)phosphorodithioate (phos-met) (CAS no. 732-11-6), formaldehyde (CAS no. 50-00-0), 2-(2-furyl)-3-(5-nitro-2-furyl)acrylamide (AF-2) (CAS no. 3688-53-7), glyoxal (CAS no. 107-22-2), 6-mercaptopurine (CAS no. 50-44-2), N-(trichloromethylthio)-4-cyclohexane-1,2-dicarboximide (captan) (CAS no. 133-06-2), 2-aminopurine (CAS no. 452-06-2), methyl methane sulfonate (MMS) (CAS No. 66-27-3), 4-nitroquinoline 1-oxide (4-NQO) (CAS No. 56-57-5), N4-Aminocytidine (CAS no. 57294-74-3), sodium azide (CAS no. 26628-22-8), N-ethyl-N-nitrosourea (ENU) (CAS no. 759-73-9), N-methyl-N-nitrosourea (MNU) (CAS no. 820-60-0), 5-azacytidine (CAS no. 320-67-2), cumene hydroperoxide (CHP) (CAS no. 80-15-9), ethyl methanesulfonate (EMS) (CAS no. 62-50-0), N-ethyl-N-nitro-N-nitrosoguanidine (ENNG) (CAS no. 4245-77-6), N-methyl-N-nitro-N-nitrosoguanidine (MNNG) (CAS no. 70-25-7), 5-diazouracil (CAS no. 2435-76-9), or t-butyl hydroperoxide (BHP) (CAS no. 75-91-2).

In some embodiments, the method comprises a phase of diversifying the population of vectors by mutagenesis, in which the cells are incubated under conditions suitable for mutagenesis of the gene to be evolved in the absence of stringent selection for vectors having acquired a gain-of-function mutation in the gene to be evolved. In some embodiments, the method comprises a phase of stringent selection for a mutated replication product of the viral vector encoding an evolved gene.

Some aspects of this disclosure provide kits comprising (a) a mutagenesis expression construct or plasmid as provided herein, wherein the expression construct comprises an inducible promoter controlling at least one of the nucleic acid sequences comprised in the expression construct; and (b) an inducing agent that induces expression from the inducible promoter. In some embodiments, the kit further comprises (c) a vector encoding an M13 phage backbone and a multiple cloning site for insertion of a nucleic acid sequence encoding a gene product to be evolved, wherein the vector or a replication product thereof can be packaged into infectious phage particles in the presence of other phage functions by suitable host cells, but lacks at least one gene required for the generation of infectious particles. In some embodiments, the kit further comprises (d) an accessory plasmid comprising a nucleic acid sequence encoding the at least one gene required for the generation of infectious particles under the control of a promoter that is activated by a desired activity of the gene product to be evolved. In some embodiments, the kit further comprises (e) an accessory plasmid comprising a nucleic acid sequence encoding a dominant-negative version of the at least one gene required for the generation of infectious particles under the control of a promoter that is activated by an undesired activity of the gene product to be evolved. In some embodiments, the kit further comprises a helper phage providing all phage functions except for the at least one gene required for the generation of infectious phage particles provided by the accessory plasmid of (d). In some embodiments, the helper phage or a replication product thereof cannot be packaged into infectious phage particles. In some embodiments, the kit comprises suitable host cells. In some embodiments, the host cells are *E. coli* host cells.

The summary above is meant to illustrate, in a non-limiting manner, some of the embodiments, advantages, features, and uses of the technology disclosed herein. Other embodiments, advantages, features, and uses of the technology disclosed herein will be apparent from the Detailed Description, the Drawings, the Examples, and the Claims.

BRIEF DESCRIPTION OF THE DRAWINGS

FIGS. 1A-1B. Mutagenesis plasmid (MP) design and effect on mutation rate in bacteria. The mutator genes tested are color-coded to indicate the canonical pathway being disrupted through the overexpression (FIG. 1A) or deletion (FIG. 1B) of that gene. All MPs express mutator genes from the arabinose-inducible $P_{BAD}$ promoter, with each gene preceded by a ribosome-binding site to allow for translation from a single transcript. For (FIG. 1A), the mutagenesis rate μ$_{bp}$ (substitutions per base pair of the E. coli genome per generation) was calculated using rifampin resistance under uninduced (25 mM glucose, white bars) and induced (25 mM glucose+25 mM arabinose, black bars). For (FIG. 1B), the rifampin resistance of XL1-Blue (white bar) and XL1-Red (black bar) was used to calculate μ$_{bp}$.

(FIG. 2A) The dynamic range of MP6 was evaluated using increasing concentrations of arabinose (black circles) in the presence of 25 mM glucose in all cases. Treatment with 200 mM glucose only (dotted line) showed low mutagenesis under identical conditions. Comparison of the mutation rate under induced and uninduced conditions reveals a 35,000-fold dynamic range. Using the number of unique mutations found in rifampin-resistant rpoB alleles (21 sites), the average number of substitutions/genome/generation (μ$_g$) was calculated for (FIG. 2B) MG1655 ΔrecA::apra without an MP (white bar) vs. carrying MP1-6 under induced conditions (black bars), and (FIG. 2C) XL1-Blue (white bar) vs. XL1-Red (black bar).

FIGS. 3A-3C. In vivo mutagenesis of M13 bacteriophage DNA. (FIG. 3A) S1030 cells (F$^+$) carrying the indicated MPs were infected with M13 bacteriophage carrying a constitutive lacZ expression cassette (SP063), accompanied by the induction of the MP using arabinose, or suppression of the MP using glucose. (FIG. 3B) XL1-Blue or XL1-Red cells were transformed with purified SP063 DNA and recovered after overnight growth. (FIG. 3C) S1021 cells (identical to S1030, but lacking F') carrying the indicated MPs were induced with arabinose or repressed with glucose for 2 h, transformed with purified SP063 DNA, and again induced with arabinose or repressed with glucose during recovery. For (FIG. 3A)-(FIG. 3C), progeny phage from the overnight propagation were plaqued on S1030 cells and stained using the X-Gal analog Bluo-Gal. The fraction of plaques that showed a white or light-blue lacZ$^-$ phenotype reflecting loss-of-function mutation(s) is shown.

(FIGS. 4A-4D) The rpoB locus of single rifampin-resistant colonies was amplified by PCR and sequenced in both clusters I (aa 451-754) and II (aa 84-401). (FIG. 4E) Identities of the rifampin-resistant rpoB alleles from MP1, MP4, or MP6 mutagenesis, or using XL1-Red. The MPs yielded a wide distribution of mutation types, with the diversity of alleles strongly correlating with MP potency. (FIGS. 4F-4I) SP063 phage containing a constitutive lacZ expression cassette was propagated on the indicated mutator strain under induced conditions, and mutations were analyzed by high-throughput sequencing. In all cases, the number of sequenced mutations (n) is indicated for the MP and XL1-Red assays. *For (FIG. 4D) and (FIG. 4E), all sequenced XL1-Red rifampin-resistant colonies carried the identical F505S/S531F rpoB genotype.

(FIG. 5A) MG1655 ΔrecA::apra cells with or without MP6 were grown for 18-21 h under induced conditions. XL1-Blue and XL1-Red were grown for 18-21 h. (FIG. 5B) MG1655 ΔrecA::apra cells were treated using chemical mutagens as previously described [32]. In all cases, cultures were plated on the indicated antibiotics following overnight culture in the absence of any selection. The numbers in parenthesis indicate the antibiotic concentrations used in g/mL. The fraction of cells resistant to each antibiotic was calculated relative to the total number of cells on plates without antibiotics. Resistance to norfloxacin was not detected for any of the tested strains or treatments. XL1-Blue and XL1-Red are both inherently resistant to tetracycline and metronidazole, so no comparison is shown for either antibiotic. See Table 6 for full antibiotic resistance data.

(FIG. 6A) Total phage titers at 10 h and 20 h after lagoon inoculation with the SP encoding T7 RNAP. (FIG. 6B) Titers of phage encoding evolved RNAP variants active on P$_{T3}$. The limit of detection is 50 pfu/mL.

(FIG. 10A) Relative cell viability was calculated as the fractional cell titer following arabinose induction as compared to the uninduced control for each MP. Viability is anti-correlated with mutagenic potency at high levels. (FIG. 10B) The XL1-Red strain shows the expected level of viability (compared to the control, XL1-Blue) given its mutagenic potency as compared to the designed MPs.

(FIG. 14A) E. coli S1030 carrying MP6 were induced with arabinose during log-phase growth and concomitantly infected with serially diluted SP063 phage. Phage were titered after overnight propagation and the fold expansion of the phage population was determined. (FIG. 14B) The percentage of white and light blue (lacZ−) plaques in the presence of Bluo-Gal suggests a correlation between phage population expansion and mutagenesis efficiency.

(FIG. 15A) *E. coli* S1030 carrying MP6 were induced with arabinose during log-phase growth and concomitantly infected with SP063 phage at defined titers. Alternatively, infection was delayed for 1 h or 2 h. (FIG. 15B) Phage were titered after overnight propagation and the percentage of white plaques in the presence of Bluo-Gal was counted.

FIG. 17A: LF Pol I[9]; FIG. 17B: mutA[37]; FIG. 17C: Mutazyme II[38]; FIG. 17D: and EMS[39].

DEFINITIONS

Figure 2A:
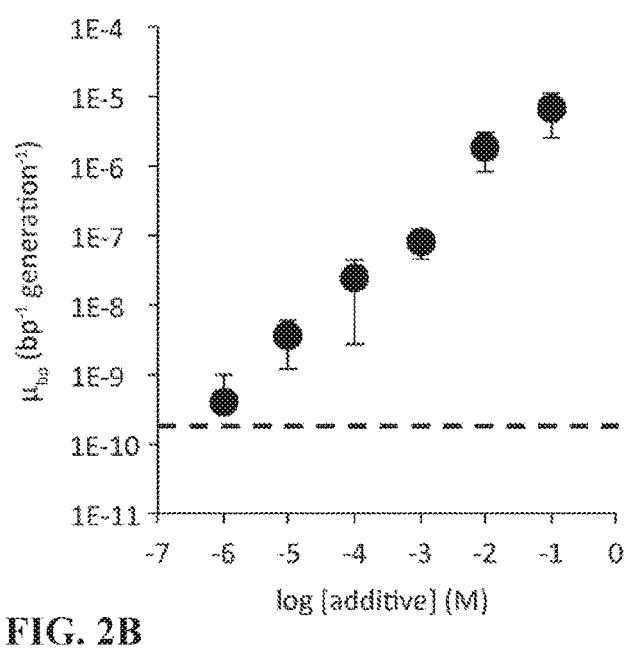
FIGS. 2A-2C. Features of the MP system.

The term "accessory plasmid," as used herein, refers to a plasmid comprising a gene required for the generation of infectious viral particles under the control of a conditional promoter. In the context of continuous evolution of genes, transcription from the conditional promoter of the accessory plasmid is typically activated, directly or indirectly, by a function of the gene to be evolved. Accordingly, the accessory plasmid serves the function of conveying a competitive advantage to those viral vectors in a given population of viral vectors that carry a version of the gene to be evolved able to activate the conditional promoter or able to activate the conditional promoter more strongly than other versions of the gene to be evolved. In some embodiments, only viral vectors carrying an "activating" version of the gene to be evolved will be able to induce expression of the gene required to generate infectious viral particles in the host cell, and, thus, allow for packaging and propagation of the viral genome in the flow of host cells. Vectors carrying non-activating versions of the gene to be evolved, on the other hand, will not induce expression of the gene required to generate infectious viral vectors, and, thus, will not be packaged into viral particles that can infect fresh host cells.

The term "cellstat," as used herein, refers to a culture vessel comprising host cells, in which the number of cells is substantially constant over time.

The term "continuous evolution," as used herein, refers to an evolution process, in which a population of nucleic acids encoding a gene to be evolved is subjected to multiple rounds of (a) replication, (b) mutation, and (c) selection to produce a desired evolved version of the gene to be evolved that is different from the original version of the gene, for example, in that a gene product, such as, e.g., an RNA or protein encoded by the gene, exhibits a new activity not present in the original version of the gene product, or in that an activity of a gene product encoded by the original gene to be evolved is modulated (increased or decreased). The multiple rounds can be performed without investigator intervention, and the steps (a)-(c) can be carried out simultaneously. Typically, the evolution procedure is carried out in vitro, for example, using cells in culture as host cells. In general, a continuous evolution process provided herein relies on a system in which a gene encoding a gene product of interest is provided in a nucleic acid vector that undergoes a life-cycle including replication in a host cell and transfer to another host cell, wherein a critical component of the life-cycle is deactivated and reactivation of the component is dependent upon an activity of the gene to be evolved that is a result of a mutation in the nucleic acid vector.

The term "flow", as used herein in the context of host cells, refers to a stream of host cells, wherein fresh host cells not harboring the transfer vector (e.g., the viral vector encoding the gene to be evolved) are being introduced into a host cell population, for example, a host cell population in a lagoon, remain within the population for a limited time, and are then removed from the host cell population. In a simple form, a host cell flow may be a flow through a tube, or a channel, for example, at a controlled rate. In other embodiments, a flow of host cells is directed through a lagoon that holds a volume of cell culture media and comprises an inflow and an outflow. The introduction of fresh host cells may be continuous or intermittent and removal may be passive, e.g., by overflow, or active, e.g., by active siphoning or pumping. Removal further may be random, for example, if a stirred suspension culture of host cells is provided, removed liquid culture media will contain freshly introduced host cells as well as cells that have been a member of the host cell population within the lagoon for some time. Even though, in theory, a cell could escape removal from the lagoon indefinitely, the average host cell will remain only for a limited period of time within the lagoon, which is determined mainly by the flow rate of the culture media (and suspended cells) through the lagoon. Since the viral vectors replicate in a flow of host cells, in which fresh, uninfected host cells are provided while infected cells are removed, multiple consecutive viral life cycles can occur without investigator interaction, which allows for the accumulation of multiple advantageous mutations in a single evolution experiment.

The term "fresh," as used herein in the context of host cells, and used interchangeably with the terms "non-infected" or "uninfected" in the context of host cells of viral vectors, refers to a host cell that does not harbor the vector or, in the context of viral vectors, has not been infected by the viral vector comprising a gene to be evolved as used in a continuous evolution process provided herein. A fresh host cell can, however, have been infected by a viral vector unrelated to the vector to be evolved or by a vector of the same or a similar type but not carrying the gene of interest.

The term "gene of interest" or "gene to be evolved," as used herein, refers to a nucleic acid construct comprising a nucleotide sequence encoding a gene product, e.g., an RNA or a protein, to be evolved in a continuous evolution process as provided herein. The term includes any variations of a gene of interest that are the result of a continuous evolution process according to methods provided herein. For example, in some embodiments, a gene of interest is a nucleic acid construct comprising a nucleotide sequence encoding an RNA or protein to be evolved, cloned into a viral vector, for example, a phage genome, so that the expression of the encoding sequence is under the control of one or more promoters in the viral genome. In other embodiments, a gene of interest is a nucleic acid construct comprising a nucleotide sequence encoding an RNA or protein to be evolved and a promoter operably linked to the encoding sequence. When cloned into a viral vector, for example, a phage genome, the expression of the encoding sequence of such genes of interest is under the control of the heterologous promoter and, in some embodiments, may also be influenced by one or more promoters comprised in the viral genome. In some embodiments, the term "gene of interest" or "gene to be evolved refers to a nucleic acid sequence encoding a gene product to be evolved, without any additional sequences. In some embodiments, the term also embraces additional sequences associated with the encoding sequence, such as, for example, intron, promoter, enhancer, or polyadenylation signal sequences.

The term "helper phage," as used herein interchangeable with the terms "helper phagemid" and "helper plasmid," refers to a nucleic acid construct comprising a phage gene required for the phage life cycle, or a plurality of such genes, but lacking a structural element required for genome packaging into a phage particle. For example, a helper phage may provide a wild-type phage genome lacking a phage origin of replication. In some embodiments, a helper phage is provided that comprises a gene required for the generation of phage particles, but lacks a gene required for the generation of infectious particles, for example, a full-length pIII gene. In some embodiments, the helper phage provides only some, but not all, genes for the generation of infectious phage particles. Helper phages are useful to allow modified phages that lack a gene for the generation of infectious phage particles to complete the phage life cycle in a host cell. Typically, a helper phage will comprise the genes for the generation of infectious phage particles that are lacking in the phage genome, thus complementing the phage genome. In the continuous evolution context, the helper phage typically complements the selection phage, but both lack a phage gene required for the production of infectious phage particles.

The terms "high copy number plasmid" and "low copy number plasmid" are art-recognized, and those of skill in the art will be able to ascertain whether a given plasmid is a high or low copy number plasmid. In some embodiments, a low copy number accessory plasmid is a plasmid exhibiting an average copy number of plasmid per host cell in a host cell population of about 5 to about 100. In some embodiments, a very low copy number accessory plasmid is a plasmid exhibiting an average copy number of plasmid per host cell in a host cell population of about 1 to about 10. In some embodiments, a very low copy number accessory plasmid is a single-copy per cell plasmid. In some embodiments, a high copy number accessory plasmid is a plasmid exhibiting an average copy number of plasmid per host cell in a host cell population of about 100 to about 5000.

The term "host cell," as used herein, refers to a cell that can host, replicate, and transfer a phage vector useful for a continuous evolution process as provided herein. In embodiments where the vector is a viral vector, a suitable host cell is a cell that can be infected by the viral vector, can replicate it, and can package it into viral particles that can infect fresh host cells. A cell can host a viral vector if it supports expression of genes of viral vector, replication of the viral genome, and/or the generation of viral particles. One criterion to determine whether a cell is a suitable host cell for a given viral vector is to determine whether the cell can support the viral life cycle of a wild-type viral genome that the viral vector is derived from. For example, if the viral vector is a modified M13 phage genome, as provided in some embodiments described herein, then a suitable host cell would be any cell that can support the wild-type M13 phage life cycle. Suitable host cells for viral vectors useful in continuous evolution processes are well known to those of skill in the art, and the disclosure is not limited in this respect.

The term "infectious viral particle," as used herein, refers to a viral particle able to transport the viral genome it comprises into a suitable host cell. Not all viral particles are able to transfer the viral genome to a suitable host cell. Particles unable to accomplish this are referred to as non-infectious viral particles. In some embodiments, a viral particle comprises a plurality of different coat proteins, wherein one or some of the coat proteins can be omitted without compromising the structure of the viral particle. In some embodiments, a viral particle is provided in which at least one coat protein cannot be omitted without the loss of infectivity. If a viral particle lacks a protein that confers infectivity, the viral particle is not infectious. For example, an M13 phage particle that comprises a phage genome packaged in a coat of phage proteins (e.g., pVIII) but lacks pIII (protein III) is a non-infectious M13 phage particle because pIII is essential for the infectious properties of M13 phage particles.

The term "lagoon," as used herein, refers to a culture vessel or bioreactor through which a flow of host cells is directed. When used for a continuous evolution process as provided herein, a lagoon typically holds a population of host cells and a population of viral vectors replicating within the host cell population, wherein the lagoon comprises an outflow through which host cells are removed from the lagoon and an inflow through which fresh host cells are introduced into the lagoon, thus replenishing the host cell population.

The term "mutagen," as used herein, refers to an agent that induces mutations or increases the rate of mutation in a given biological system, for example, a host cell, to a level above the naturally occurring level of mutation in that system. Some exemplary mutagens useful for continuous evolution procedures are provided elsewhere herein, and other useful mutagens will be evident to those of skill in the art. Useful mutagens include, but are not limited to, ionizing radiation, ultraviolet radiation, base analogs, deaminating agents (e.g., nitrous acid), intercalating agents (e.g., ethidium bromide), alkylating agents (e.g., ethylnitrosourea), transposons, bromine, azide salts, psoralen, benzene, 3-Chloro-4-(dichloromethyl)-5-hydroxy-2(5H)-furanone (MX) (CAS no. 77439-76-0), O,O-dimethyl-S-(phthalimidomethyl)phosphorodithioate (phos-met) (CAS no. 732-11-6), formaldehyde (CAS no. 50-00-0), 2-(2-furyl)-3-(5-nitro-2-furyl)acrylamide (AF-2) (CAS no. 3688-53-7), glyoxal (CAS no. 107-22-2), 6-mercaptopurine (CAS no. 50-44-2), N-(trichloromethylthio)-4-cyclohexane-1,2-dicarboximide (captan) (CAS no. 133-06-2), 2-aminopurine (CAS no. 452-06-2), methyl methane sulfonate (MMS) (CAS No. 66-27-3), 4-nitroquinoline 1-oxide (4-NQO) (CAS No. 56-57-5), N4-Aminocytidine (CAS no. 57294-74-3), sodium azide (CAS no. 26628-22-8), N-ethyl-N-nitrosourea (ENU) (CAS no. 759-73-9), N-methyl-N-nitrosourea (MNU) (CAS no. 820-60-0), 5-azacytidine (CAS no. 320-67-2), cumene hydroperoxide (CHP) (CAS no. 80-15-9), ethyl methanesulfonate (EMS) (CAS no. 62-50-0), N-ethyl-N-nitro-N-nitrosoguanidine (ENNG) (CAS no. 4245-77-6), N-methyl-N-nitro-N-nitrosoguanidine (MNNG) (CAS no. 70-25-7), 5-diazouracil (CAS no. 2435-76-9), and t-butyl hydroperoxide (BHP) (CAS no. 75-91-2). Additional mutagens can be used in continuous evolution procedures as provided herein, and the invention is not limited in this respect.

The term "mutagenesis plasmid," as used herein, refers to a plasmid comprising a nucleic acid sequence encoding a gene product or a combination of gene products that act(s) as a mutagen.

The term "nucleic acid," as used herein, refers to a polymer of nucleotides. The polymer may include natural nucleosides (i.e., adenosine, thymidine, guanosine, cytidine, uridine, deoxyadenosine, deoxythymidine, deoxyguanosine, and deoxycytidine), nucleoside analogs (e.g., 2-aminoadenosine, 2-thiothymidine, inosine, pyrrolo-pyrimidine, 3-methyl adenosine, 5-methylcytidine, C5-bromouridine, C5-fluorouridine, C5-iodouridine, C5-propynyl-uridine, C5-propynyl-cytidine, C5-methylcytidine, 7-deazaadenosine, 7-deazaguanosine, 8-oxoadenosine, 8-oxoguanosine, O(6)-methylguanine, 4-acetylcytidine, 5-(carboxyhydroxymethyl)uridine, dihydrouridine, methylpseudouridine, 1-methyl adenosine, 1-methyl guanosine, N6-methyl adenosine, and 2-thiocytidine), chemically modified bases, biologically modified bases (e.g., methylated bases), intercalated bases, modified sugars (e.g., 2'-fluororibose, ribose, 2'-deoxyribose, 2'-O-methylcytidine, arabinose, and hexose), or modified phosphate groups (e.g., phosphorothioates and 5'-N-phosphoramidite linkages).

The term "phage," as used herein interchangeably with the term "bacteriophage," refers to a virus that infects bacterial cells. Typically, phages consist of an outer protein capsid enclosing genetic material. The genetic material can be ssRNA, dsRNA, ssDNA, or dsDNA, in either linear or circular form. Phages and phage vectors are well known to those of skill in the art and non-limiting examples of phages that are useful for carrying out the methods provided herein are λ (Lysogen), T2, T4, T7, T12, R17, M13, MS2, G4, P1, P2, P4, Phi X174, N4, Φ6, and Φ29. In certain embodiments, the phage utilized in the present invention is M13. Additional suitable phages and host cells will be apparent to those of skill in the art and the invention is not limited in this aspect. For an exemplary description of additional suitable phages and host cells, see Elizabeth Kutter and Alexander Sulakvelidze: *Bacteriophages: Biology and Applications*. CRC Press; 1$^{st}$ edition (December 2004), ISBN: 0849313368; Martha R. J. Clokie and Andrew M. Kropinski: *Bacteriophages: Methods and Protocols, Volume 1: Isolation, Characterization, and Interactions (Methods in Molecular Biology)* Humana Press; 1$^{st}$ edition (December, 2008), ISBN: 1588296822; Martha R. J. Clokie and Andrew M. Kropinski: *Bacteriophages: Methods and Protocols, Volume 2: Molecular and Applied Aspects (Methods in Molecular Biology)* Humana Press; 1$^{st}$ edition (December 2008), ISBN: 1603275649; all of which are incorporated herein in their entirety by reference for disclosure of suitable phages and host cells as well as methods and protocols for isolation, culture, and manipulation of such phages).

The term "phage-assisted continuous evolution (PACE)," as used herein, refers to continuous evolution that employs phage as viral vectors. PACE technology has been described previously, for example, in International PCT Application, PCT/US2009/056194, filed Sep. 8, 2009, published as WO 2010/028347 on Mar. 11, 2010; International PCT Application, PCT/US2011/066747, filed Dec. 22, 2011, published as WO 2012/088381 on Jun. 28, 2012; U.S. Application, U.S. Ser. No. 13/922,812, filed Jun. 20, 2013; and U.S. Application, U.S. Ser. No. 62/067,194, filed Oct. 22, 2014, each of which is incorporated herein by reference.

The term "promoter" is art-recognized and refers to a nucleic acid molecule with a sequence recognized by the cellular transcription machinery and able to initiate transcription of a downstream gene. A promoter can be constitutively active, meaning that the promoter is always active in a given cellular context, or conditionally active, meaning that the promoter is only active in the presence of a specific condition. For example, a conditional promoter may only be active in the presence of a specific protein that connects a protein associated with a regulatory element in the promoter to the basic transcriptional machinery, or only in the absence of an inhibitory molecule. A subclass of conditionally active promoters are inducible promoters that require the presence of a small molecule "inducer" for activity. Examples of inducible promoters include, but are not limited to, arabinose-inducible promoters, Tet-on promoters, and tamoxifen-inducible promoters. A variety of constitutive, conditional, and inducible promoters are well known to the skilled artisan, and the skilled artisan will be able to ascertain a variety of such promoters useful in carrying out the instant invention, which is not limited in this respect.

The term "protein," as used herein refers to a polymer of amino acid residues linked together by peptide bonds. The term, as used herein, refers to proteins, polypeptides, and peptide of any size, structure, or function. Typically, a protein will be at least three amino acids long. A protein may refer to an individual protein or a collection of proteins. Inventive proteins preferably contain only natural amino acids, although non-natural amino acids (i.e., compounds that do not occur in nature but that can be incorporated into a polypeptide chain; see, for example, cco.caltech.edu/~dadgrp/Unnatstruct.gif, which displays structures of non-natural amino acids that have been successfully incorporated into functional ion channels) and/or amino acid analogs as are known in the art may alternatively be employed. Also, one or more of the amino acids in an inventive protein may be modified, for example, by the addition of a chemical entity such as a carbohydrate group, a hydroxyl group, a phosphate group, a farnesyl group, an isofarnesyl group, a fatty acid group, a linker for conjugation, functionalization, or other modification, etc. A protein may also be a single molecule or may be a multi-molecular complex. A protein may be just a fragment of a naturally occurring protein or peptide. A protein may be naturally occurring, recombinant, or synthetic, or any combination of these.

The term "replication product," as used herein, refers to a nucleic acid that is the result of viral genome replication by a host cell. This includes any viral genomes synthesized by the host cell from a viral genome inserted into the host cell. The term includes non-mutated as well as mutated replication products.

The term "selection phage," as used herein interchangeably with the term "selection plasmid," refers to a modified phage that comprises a gene of interest to be evolved and lacks a full-length gene encoding a protein required for the generation of infectious phage particles. For example, some M13 selection phages provided herein comprise a nucleic acid sequence encoding a gene to be evolved, e.g., under the control of an M13 promoter, and lack all or part of a phage gene encoding a protein required for the generation of infectious phage particles, e.g., gI, gII, gIII, gIV, gV, gVI, gVII, gVIII, gIX, or gX, or any combination thereof. For example, some M13 selection phages provided herein comprise a nucleic acid sequence encoding a gene to be evolved, e.g., under the control of an M13 promoter, and lack all or part of a gene encoding a protein required for the generation of infective phage particles, e.g., the gIII gene encoding the pIII protein.

The terms "small molecule" and "organic compound" are used interchangeably herein and refer to molecules, whether naturally-occurring or artificially created (e.g., via chemical synthesis) that have a relatively low molecular weight. Typically, an organic compound contains carbon. An organic compound may contain multiple carbon-carbon bonds, stereocenters, and other functional groups (e.g., amines, hydroxyl, carbonyls, or heterocyclic rings). In some embodiments, organic compounds are monomeric and have a molecular weight of less than about 1500 g/mol. In certain embodiments, the molecular weight of the small molecule is less than about 1000 g/mol or less than about 500 g/mol. In certain embodiments, the small molecule is a therapeutic drug or drug candidate, for example, a drug or drug candidate that is in clinical or pre-clinical trials or that has already been deemed safe and effective for use in humans or animals by the appropriate governmental agency or regulatory body.

The term "turbidostat," as used herein, refers to a culture vessel comprising host cells in suspension culture, in which the turbidity of the culture medium is substantially essentially constant over time. In some embodiments, the turbidity of a suspension culture, for example, of bacterial cells, is a measure for the cell density in the culture medium. In some embodiments, a turbidostat comprises an inflow of fresh media and an outflow, and a controller that regulates the flow into and/or out of the turbidostat based on the turbidity of the suspension culture in the turbidostat.

The term "vector," as used herein, refers to a nucleic acid that can be modified to encode a gene of interest and that is able to enter into a host cell, mutate and replicate within the host cell, and then transfer a replicated form of the vector into another host cell. Exemplary suitable vectors include viral vectors, such as retroviral vectors or bacteriophages, and conjugative plasmids. Additional suitable vectors will be apparent to those of skill in the art based on the instant disclosure.

The term "viral life cycle," as used herein, refers to the viral reproduction cycle comprising insertion of the viral genome into a host cell, replication of the viral genome in the host cell, and packaging of a replication product of the viral genome into a viral particle by the host cell.

The term "viral particle," as used herein, refers to a viral genome, for example, a DNA or RNA genome, that is associated with a coat of a viral protein or proteins, and, in some cases, with an envelope of lipids. For example, a phage particle comprises a phage genome packaged into a protein encoded by the wild type phage genome.

The term "viral vector," as used herein, refers to a nucleic acid comprising a viral genome that, when introduced into a suitable host cell, can be replicated and packaged into viral particles able to transfer the viral genome into another host cell. The term viral vector extends to vectors comprising truncated or partial viral genomes. For example, in some embodiments, a viral vector is provided that lacks a gene encoding a protein essential for the generation of infectious viral particles. In suitable host cells, for example, host cells comprising the lacking gene under the control of a conditional promoter, however, such truncated viral vectors can replicate and generate viral particles able to transfer the truncated viral genome into another host cell. In some embodiments, the viral vector is a phage, for example, a filamentous phage (e.g., an M13 phage). In some embodiments, a viral vector, for example, a phage vector, is provided that comprises a gene of interest to be evolved.

DETAILED DESCRIPTION

Introduction

Some aspects of this disclosure provide systems, vectors, and methods for modulating the mutation rates in cells, for example, in bacterial host cells. In some embodiments, the present disclosure provides mutagenesis vectors, sometimes referred to herein as mutagenesis expression constructs or, if in the form of a plasmid, as mutagenesis plasmids, that mediate highly potent, broad-spectrum, and controllable mutagenesis in bacterial cells. These vectors can be used in many bacterial strains, including, but not limited to, most *E. coli* strains, to mutagenize chromosomal, episomal, or viral DNA, enabling high-efficiency mutation, for example, during directed evolution, obviating the need to create random DNA libraries in vitro, and bypassing transformation efficiency bottlenecks. Some advantages of the systems, vectors, and methods for modulating the mutation rates in bacteria as provided herein include, for example, the ability to evolve a gene of interest in a significantly reduced time frame as compared to other mutagenic technologies, and the fact that the mutagenesis-inducing vectors and constructs are not harmful to humans, in contrast to many other mutagens (e.g., chemical mutagens, UV, or ionizing radiation) commonly used. The utility and the improved mutation rate of this system is demonstrated herein by evolving resistance to eight antibiotics in bacterial cells significantly more effectively than when using several other widely used mutagenesis methods. The mutagenesis efficiency conferred by the systems, vectors, and methods provided herein is exemplified herein by an exemplary use of some embodiments of these systems, vectors, and methods to evolve RNA polymerase specificity in bacteriophage under conditions that previously necessitated the use of mutational drift or evolutionary stepping-stones.

Access to new mutations drives both natural and laboratory evolution. Native biological mutation rates, sometimes referred to herein as "basal mutation rates," are modest, occurring at frequencies of approximately one mutation per billion replicated DNA bases in most eukaryotes and prokaryotes [1]. Under such native mutation conditions, the time to evolve gene variants that improve organismal fitness is strongly determined by the time required for the mutation to appear [2]. Laboratory evolution methods typically increase basal mutation rates to accelerate the discovery of biomolecules with desired properties on a practical time scale. In addition to mutation rate, the mutational spectrum is also a crucial component of the genetic diversity that fuels evolution. Access to diverse amino acid substitutions during evolution is enhanced by more complete coverage of the 12 possible mutation types [3].

Several systems to enhance mutational efficiency and broaden mutational spectra have been developed for use in laboratory evolution efforts [4]. In vitro mutagenesis through error-prone PCR, site-saturation mutagenesis, or DNA shuffling has become the standard approach to introduce diversity into genes of interest. Whereas in vitro mutagenesis methods allow for control of mutation rate and mutational spectrum, in vivo mutagenesis methods allow for mutation and selection cycles to be coupled, bypass transformation efficiency bottlenecks that frequently limit the size of gene populations that can be accessed following in vitro mutagenesis, and avoid labor-intensive library creation, cloning, and manipulation steps [5]. The difficulty of tuning mutagenic load and spectrum in live cells, however, has prevented the development of safe, effective in vivo mutagenesis methods that can rival or exceed the efficiency and mutational spectra of state-of-the-art in vitro methods.

The most commonly used in vivo mutagenesis methods include chemical mutagens, nucleobase analogs, UV light, and hypermutator strains [3]. Chemical mutagens yield narrow mutagenic spectra and are potent human carcinogens. Base analogs offer a safer alternative to chemical mutagenesis, but also exhibit narrow mutational spectra. UV radiation is known to generate a wide mutation spectrum with little sequence preference, but with low potency that is limited by the toxicity of high doses of UV radiation.

Perhaps the most widespread method for in vivo mutagenesis has been the use of hypermutator strains such as XL-1 Red [6] that have been engineered to have higher mutation rates through the deletion or modification of genes involved in DNA replication and repair. These strains suffer from numerous drawbacks, however, including modest mutational potency (vide infra), moderately biased mutational preference [7], poor transformation efficiency, slow growth rate, and difficulty of modification when additional genetic manipulations are required. In addition, the rate of mutagenesis is not controllable using common hypermutator strains, and mutagenesis generally must be separated from other steps such as selection or screening due to the instability or poor growth of the strain. Loeb and coworkers previously described an elegant system that uses a low-fidelity *E. coli* DNA Pol I (LF-Pol I) to increase in vivo mutagenesis efficiency with a wide scope of mutational types [8]. Unfortunately, this method is restricted to Pol I temperature-sensitive strains and mutates only vectors carrying ColE1-related origins of replication, with mutation rate being highly dependent on distance from the ColE1 origin [8, 9].

An in vivo mutagenesis method should offer one or more of the following: (i) a broad mutagenesis spectrum, (ii) a mutation rate that can be very high but is easily modulated by the researcher, and (iii) entirely episomal encoding so that it can be applied to virtually any bacterial strain, including, but not limited to, virtually any *E. coli* strain. Some aspects of this disclosure describe the development of general in vivo mutagenesis systems, vectors, and method that meet these criteria.

Mutagenesis Constructs

Some aspects of this disclosure provide expression constructs encoding gene products that increase the mutation rate in a host cell, e.g., in a bacterial host cell. Expression constructs are sometimes also referred to as vectors. In some embodiments, the expression constructs are plasmids, also referred to herein as mutagenesis plasmids. The use of mutagenesis plasmids in the context of directed evolution has previously been described (e.g., in International PCT Application, PCT/US2009/056194, filed Sep. 8, 2009, published as WO 2010/028347 on Mar. 11, 2010; International PCT Application, PCT/US2011/066747, filed Dec. 22, 2011, published as WO 2012/088381 on Jun. 28, 2012; U.S. Application, U.S. Ser. No. 13/922,812, filed Jun. 20, 2013; and U.S. Application, U.S. Ser. No. 62/067,194, filed Oct. 22, 2014, the entire contents of each of which are incorporated herein by reference). Some aspects of this disclosure provide improved mutagenesis systems and expression constructs using various combinations of mutagenesis-inducing gene products. The expression constructs provided herein can be used to induce mutagenesis in a target cell, e.g., in a bacterial host cell, at increased rates as compared to conventional mutagenesis agents and methods.

Some aspects of this disclosure provide expression constructs for modulating the mutation rate of nucleic acids in a cell, e.g., in a bacterial, yeast, or eukaryotic cell. In some embodiments, the expression construct comprises a nucleic acid sequence encoding a gene product that disrupts a proof-reading pathway, a translesion synthesis pathway, a methyl-directed mismatch repair pathway, a base excision repair pathway, or a base selection pathway of the bacterial cell, or any combination thereof, wherein the nucleic acid sequence encoding the gene product is under the control of a heterologous promoter.

Figure 7:
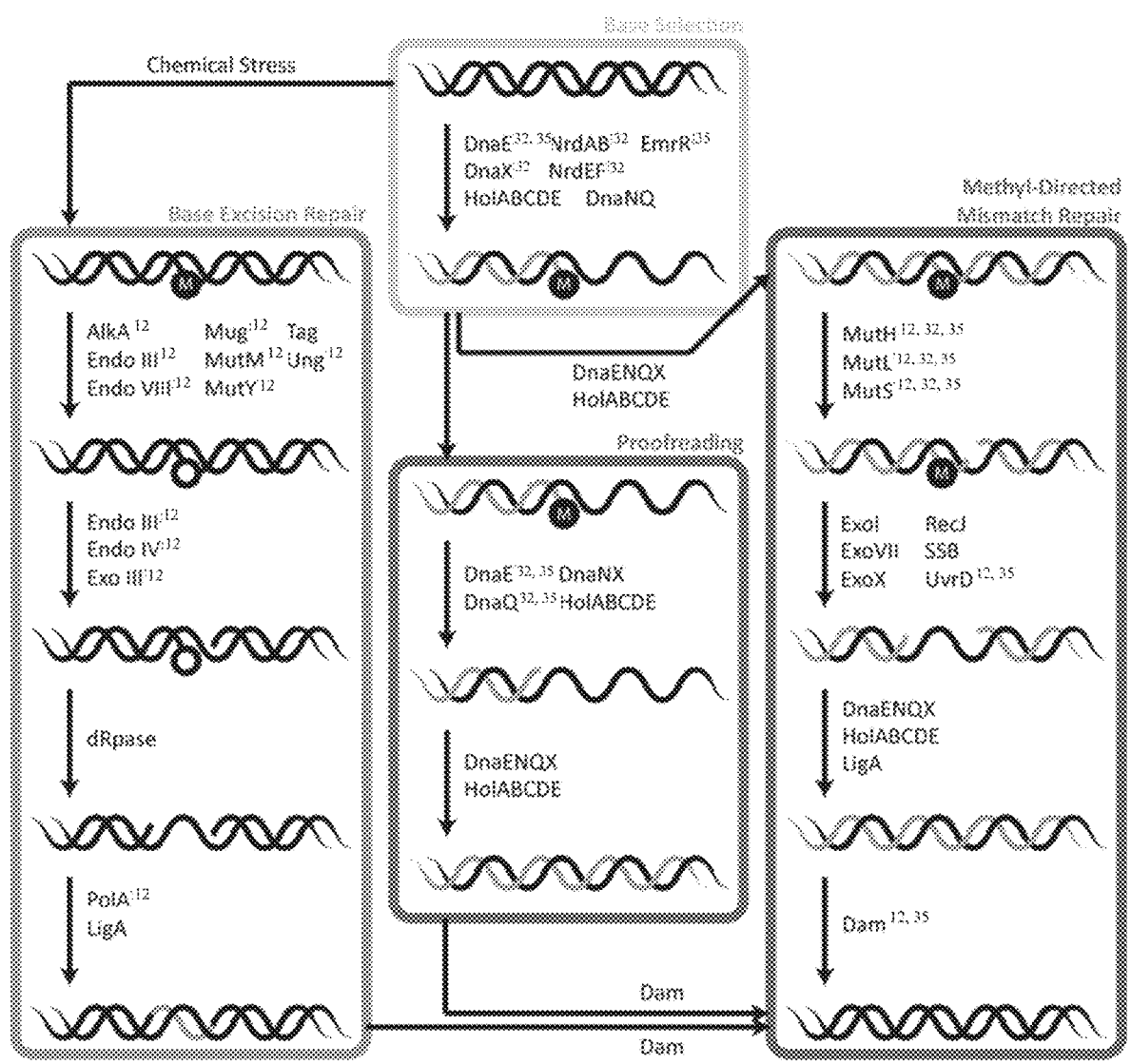
FIG. 7. Summary of major pathways that influence E. coli DNA replication fidelity. Steps during replication and mutation correction are grouped according to their mechanisms of action. Methylated DNA is shown in black, unmethylated DNA is shown in grey, and the mutation to be corrected is depicted as "M". Gene superscripts denote if a mutator phenotype results upon gene deletion [43] (1), gene overexpression [17, 20, 25, 46, 48] (2) or modification of the chromosomal allele to circumvent potential knockout lethality [17, 20, 25, 46, 48, 49] (3).

Some aspects of this disclosure provide expression constructs encoding a combination of mutagenesis-inducing gene products that allow for robust DNA mutagenesis, e.g., robust chromosomal, episomal, and viral DNA mutagenesis in host cells, e.g., in bacterial host cells. Some exemplary, non-limiting, combinations of mutagenesis-inducing gene products are listed in Table 2 or FIG. 7. The nomenclature of the nucleotides (e.g., genes, transcripts) and proteins referred to herein adheres to the official nomenclature used by the National Center for Biotechnology Information (NCBI). Nucleotide and protein sequences related to the gene symbols listed herein, e.g., in Table 2 or FIG. 7, are known to those of skill in the art. For gene symbols for which publications are indicated (e.g., by superscript numbers or in square brackets), any sequences provided in the publication related to the gene symbol is incorporated herein by reference. In some embodiments, the gene symbols above relate to nucleotide and protein sequences accessible under that gene symbol in any of the National Center for Biotechnology Information (NCBI) databases, for example, in the Nucleotide Reference Sequence (RefSeq) database, release 69 (Jan. 2, 2015), or in the Unigene database available at the time of filing, and any NCBI database entries, e.g., RefSeq database entries for the listed genes in the ResSeq database, release 69, or in the Unigene database at the time of filing, are incorporated herein by reference.

In some embodiments, a plurality of nucleic acid sequences encoding a gene product that increases the mutation rate in a cell are employed, e.g., combinations of such gene products as shown in Table 2 or FIG. 7. For example, in some embodiments, an a mutagenesis construct provided herein comprises at least two, at least three, at least four, at least 5, at least 6, at least 7, at least 8, at least 9, or at least 10 different nucleic acid sequences encoding a different gene product, e.g., a gene product of Table 2 or FIG. 7. For example, in some embodiments, a mutagenesis expression construct as provided herein may include at least a combination of sequences encoding dnaQ92640, umuD', umuC, and recA730, and at least one, at least two, at least three, at least four, or at least five additional nucleic acid sequence encoding a different gene product listed in Table 2 or FIG. 7. In some embodiments, a mutagenesis expression construct as provided herein may include at least a combination of sequences encoding dnaQ926, dam, and seqA, and at least one, at least two, at least three, at least four, or at least five additional nucleic acid sequence encoding a different gene product listed in Table 2 or FIG. 7.

It will be understood that, in some embodiments, the expression constructs provided herein include wild-type sequences of the genes or encoding sequences provided herein, e.g., in Table 2 or FIG. 7, while in other embodiments, one or more of the genes or encoding sequences used may be a functional variant, mutant, fragment, or recombinant form of a wild-type sequence. Such functional variants, mutants, fragments, or recombinant forms include sequences with silent mutations, e.g., codon-optimized sequences, in which nucleotides have been exchanged without altering the sequence of an encoded gene product (e.g., an encoded protein), sequences comprising naturally-occurring polymorphisms, truncations of wild-type sequences that retain the function of the wild-type sequence (e.g., 5'- or 3' UTR truncations, intron deletions (e.g., cDNAs), and deletions of domains not required for gene product function, and fusions with other sequences, including, e.g., sequences encoding a tag or other gene product. Suitable variants, mutants, fragments, or recombinant forms of wild-type sequences provided herein will be apparent to the skilled artisan based on the instant disclosure.

In some embodiment, the present disclosure provides expression constructs for modulating the mutagenesis rate in bacterial cells harboring such constructs, also referred to herein as host cells. Such expression constructs can be configured in any suitable manner for introduction into and expression in a bacterial cell, e.g., in the form of a plasmid, cosmid, bacteriophage, or artificial bacterial chromosome. In embodiments, where the expression construct is configured as or comprised in a plasmid, such plasmids are also sometimes referred to herein as "mutagenesis plasmids." In some embodiments, the bacterial expression constructs provided herein allow for modulation of mutagenesis in bacterial host cells in a strain-independent manner.

In some embodiments, an expression construct for modulating the mutagenesis rate in a bacterial host cell as provided herein may encode a DNA polymerase lacking a proofreading capability. In some embodiments, the expression construct may encode a gene product involved in the bacterial SOS stress response, for example, a component of a bacterial translesion synthesis polymerase V. In some embodiments, the expression construct may encode a deoxyadenosine methylase. In some embodiments, the expression construct may encode a hemimethylated-GATC binding domain. In some non-limiting embodiments, the expression construct encodes UmuC (a component of E. coli translesion synthesis polymerase V), dam (deoxyadenosine methylase), and/or seqA (hemimethylated-GATC binding domain), or any combination thereof.

In some embodiments, the expression construct for modulating the mutagenesis rate in a bacterial host cell comprises a nucleic acid sequence encoding a gene product that disrupts a proofreading pathway, a translesion synthesis pathway, a methyl-directed mismatch repair pathway, a base excision repair pathway, or a base selection pathway of the bacterial cell, or any combination thereof, wherein the nucleic acid sequence encoding the gene product is under the control of a heterologous promoter.

In some embodiments, the gene product that disrupts a proofreading pathway is a dnaQ926, BRM1, BR11, BR1, BR6, or BR13 gene product. In some embodiments, the gene product that disrupts a translesion synthesis pathway is an umuD', umuC, recA, dinB, or polB gene product.

In some embodiments, the gene product that disrupts a translesion synthesis pathway is an umuD', umuC, recA, dinB, or polB gene product. In some embodiments, the recA gene product is a recA730 gene product. In some embodiments, the polB gene product is a polB(D156A) gene product. In some embodiments, the gene product that disrupts a methyl-directed mismatch repair pathway is a mutS, mutL, mutH, dam, or seqA gene product. In some embodiments, the mutS gene product is a mutS538, mutS503, or mutSΔN gene product. In some embodiments, the mutL gene product is a mutL705, mutL713, mutL(R261H), or mutL(K307A) gene product. In some embodiments, the mutH gene product is a mutH(E56A), mutH(K79E), or mutH(K116E) gene product. In some embodiments, the gene product that disrupts a base excision repair pathway is a ugi, AID, APOBEC, CDA, MAG, or AAG gene product. In some embodiments, the AID gene product is an AID(7), AID(7.3), AID(7.3.5), AID(7.3.3), AID(7.3.1), or AID (7.3.2) gene product. In some embodiments, the APOBEC gene product is an APOBEC 1 gene product. In some embodiments, the CDA gene product is a CDA1 gene product. In some embodiments, the MAG gene product is a MAG1 gene product. In some embodiments, the AAG gene product is an AAG(Y127I-H136L) or Δ80-AAG(Y127I-H136L) gene product.

In some embodiments, the gene product that disrupts a base selection pathway is a dnaE74, dnaE486, dnaE1026, dnaX36, dnaX2016, emrR, nrdAB, nrdA(H59A)B, nrdA(A65V)B, nrdA(A301V)B, nrdAB(P334L), or nrdEF gene product.

In some embodiments, the expression construct comprises a nucleic acid sequence encoding a rsmE, cchA, yffI, or yfjY gene product.

In some embodiments, the expression construct comprises a nucleic acid sequence encoding a dnaQ926 gene product. In some embodiments, the expression construct further comprises a nucleic acid sequence encoding a umuD', umuC, or recA730 gene product, or any combination thereof. In some embodiments, the expression construct further comprises a nucleic acid sequence encoding a dnaE486, dnaE1026, dnaX36, or dnaX2016 gene product, or any combination thereof. In some embodiments, the expression construct further comprises a nucleic acid sequence encoding a mutS538, mutS503, mutL705, mutL713, mutL (R261H), mutL(K307A), mutH(E56A), mutH(K79E), or mutH(K116E) gene product, or any combination thereof. In some embodiments, the expression construct further comprises a nucleic acid sequence encoding a Dam gene product. In some embodiments, the expression construct further comprises a nucleic acid sequence encoding a seqA gene product. In some embodiments, the expression construct further comprises a nucleic acid sequence encoding a emrR, mutH(E56A), mutL713, mutS503, mutSΔN, dinB, or polB gene product, or any combination thereof.

In some embodiments, the expression construct comprises a nucleic acid sequence encoding a Dam gene product. In some embodiments, the expression construct further comprises a nucleic acid sequence encoding a seqA gene product. In some embodiments, the expression construct further comprises a nucleic acid sequence encoding a emrR gene product. In some embodiments, the expression construct further comprises a nucleic acid sequence encoding a ugi gene product. In some embodiments, the expression construct further comprises a nucleic acid sequence encoding a AID, AID(7), AID(7.3), AID(7.3.5), AID(7.3.3), AID(7.3.1), AID(7.3.2), APOBEC1, or CDA1 gene product, or any combination thereof. In some embodiments, the expression construct further comprises a nucleic acid sequence encoding a mutSΔN gene product. In some embodiments, the expression construct further comprises a nucleic acid sequence encoding a rsmE, cchA, yffI, yfjY, nrdAB, nrdA (H59A)B, nrdA(A65V)B, nrdA(A301V)B, nrdEF, or nrdAB (P334L)gene product, or any combination thereof.

In some embodiments, the expression construct comprises a nucleic acid sequence encoding a dnaE74 gene product. In some embodiments, the expression construct comprises a nucleic acid sequence encoding a dnaE486 gene product. In some embodiments, the expression construct comprises a nucleic acid sequence encoding a dnaE1026 gene product. In some embodiments, the expression construct comprises a nucleic acid sequence encoding a dnaX36 gene product. In some embodiments, the expression construct comprises a nucleic acid sequence encoding a dnaX2016 gene product. In some embodiments, the expression construct comprises a nucleic acid sequence encoding a rpsD12 gene product. In some embodiments, the expression construct comprises a nucleic acid sequence encoding a rpsD14 gene product. In some embodiments, the expression construct comprises a nucleic acid sequence encoding a rpsD16 gene product. In some embodiments, the expression construct comprises a nucleic acid sequence encoding a polB gene product. In some embodiments, the expression construct comprises a nucleic acid sequence encoding a polB(D156A) gene product. In some embodiments, the expression construct comprises a nucleic acid sequence encoding a MAG1 gene product. In some embodiments, the expression construct comprises a nucleic acid sequence encoding a AAG(Y127I-H136L) gene product. In some embodiments, the expression construct comprises a nucleic acid sequence encoding a Δ80-AAG(Y127I-H136L) gene product.

In some embodiments, the expression construct is comprised in a plasmid. In some embodiments, the plasmid comprises a bacterial origin of replication. In some embodiments, the origin of replication is a cloDF13 origin of replication. In some embodiments, the plasmid comprises a nucleic acid sequence encoding a gene product conferring resistance to an antibiotic to a bacterial host cell. In some embodiments, the antibiotic is chloramphenicol, kanamycin, tetracycline, or ampicillin.

In some embodiments, the expression construct comprises at least one inducible promoter controlling the expression of at least one nucleic acid sequence encoding the gene product that disrupts a proofreading pathway, a translesion synthesis pathway, a methyl-directed mismatch repair pathway, a base excision repair pathway, or a base selection pathway, or any combination thereof. In some embodiments, the inducible promoter controls the expression of a nucleic acid encoding a combination of two or more mutagenic gene products, e.g., of any combination listed in Table 2 or FIG. 7. In some embodiments, the expression construct comprises an inducible promoter controlling expression of a nucleic acid sequence encoding a component of E. coli translesion synthesis polymerase V, a deoxyadenosine methylase, and/or a hemimethylated-GATC binding domain, or any combination thereof. In some embodiments, the component of E. coli translesion synthesis polymerase V is umuC. In some embodiments, the deoxyadenosine methylase is dam. In some embodiments, the hemimethylated-GATC binding domain is seqA. In some embodiments, the nucleic acid sequence controlled by the inducible promoter encodes at least one, at least two, at least three, or at least four additional mutagenic gene products, e.g., as listed in Table 2 or FIG. 7. In some embodiments, the inducible promoter is an arabinose responsive promoter. In some embodiments, the arabinose responsive promoter is a $P_{BAD}$ promoter. In some embodiments, the expression construct comprises a nucleic acid sequence encoding an arabinose operon regulatory protein. In some embodiments, the arabinose operon regulatory protein is araC. In some embodiments, the nucleic acid sequence encoding the arabinose operon regulatory protein is under the control of a weak promoter. In some embodiments, the weak promoter is a $P_C$ promoter.

In some embodiments, the expression construct comprises at least one codon-optimized nucleic acid sequence encoding a gene product. Methods for codon-optimization and codons preferred by various types of bacterial host cells are well known to those of skill in the art. Some exemplary suitable methods and codons are provided herein, and additional methods and codons will be apparent to the skilled artisan based on the present disclosure. In some embodiments, the codon-optimized nucleic acid sequence comprises at least one codon of a naturally-occurring sequence encoding the gene product that has been replaced with a different codon encoding the same amino acid. In some embodiments, the at least one codon replacing the codon of the naturally occurring nucleic acid sequence corresponds to a tRNA expressed in a bacterial host cell, e.g., in an E. coli host cell. In some embodiments, the at least one codon replacing the codon of the naturally occurring nucleic acid sequence corresponds to a tRNA that is expressed at a higher abundance in the bacterial host cell than the tRNA relating to the naturally occurring tRNA. In some embodiments, the expression construct comprises a nucleic acid sequence encoding a ribosome-binding site, wherein at least one ribosome-binding site encoded by the expression construct is modified as compared to a naturally occurring ribosome binding site. In some embodiments, the modified ribosome binding site exhibits increased ribosome binding as compared to the naturally occurring ribosome binding site. Ribosome-binding sites preferred by ribosomes in various host cells are well known to those of skill in the art.

In some embodiments, the expression construct comprises a nucleic acid sequence encoding a gene product or a combination of such sequences listed in Table 2 or FIG. 7.

Some aspects of this disclosure provide plasmids comprising an expression construct as disclosed herein.

Some aspects of this disclosure provide a cell comprising an expression construct or a plasmid as provided herein. In some embodiments, the cell is a bacterial cell. In some embodiments, the cell further comprises a selection plasmid or an accessory plasmid. In some embodiments, the cell is a host cell for a bacteriophage. In some embodiments, the cell is an E. coli cell. In some embodiments, the cell is comprised in a lagoon.

Some aspects of this disclosure provide vectors and reagents for carrying out continuous evolution processes using the inventive mutagenesis constructs. Such vectors and reagents comprise, for example, selection phage, accessory plasmid, and helper plasmid vectors.

In some embodiments, a selection phage is provided that comprises a phage genome deficient in at least one gene required for the generation of infectious phage particles and a gene encoding a gene of interest to be evolved.

For example, in some embodiments, a selection phage as described in PCT Application PCT/US2009/056194, published as WO2010/028347 on Mar. 11, 2010; PCT Application PCT/US2011/066747, published as WO2012/088381 on Jun. 28, 2012; and U.S. Application, U.S. Ser. No. 13/922,812, filed Jun. 20, 2013, the entire contents of each of which are incorporated herein by reference, is provided, that comprises a multiple cloning site for insertion of a nucleic acid sequence encoding a gene to be evolved of interest.

Such selection phage vectors typically comprise an M13 phage genome deficient in a gene required for the generation of infectious M13 phage particles, for example, a full-length gIII. In some embodiments, the selection phage comprises a phage genome providing all other phage functions required for the phage life cycle except the gene required for generation of infectious phage particles. In some such embodiments, an M13 selection phage is provided that comprises a gI, gII, gIV, gV, gVI, gVII, gVIII, gIX, and a gX gene, but not a full-length gIII. In some embodiments, the selection phage comprises a 3'-fragment of gIII, but no full-length gIII. The 3'-end of gIII comprises a promoter and retaining this promoter activity is beneficial, in some embodiments, for an increased expression of gVI, which is immediately downstream of the gIII 3'-promoter, or a more balanced (wild-type phage-like) ratio of expression levels of the phage genes in the host cell, which, in turn, can lead to more efficient phage production. In some embodiments, the 3'-fragment of gIII gene comprises the 3'-gIII promoter sequence. In some embodiments, the 3'-fragment of gIII comprises the last 180 bp, the last 150 bp, the last 125 bp, the last 100 bp, the last 50 bp, or the last 25 bp of gII. In some embodiments, the 3'-fragment of gIII comprises the last 180 bp of gII. In some embodiments, the multiple cloning site for insertion of the gene of interest is located downstream of the gVIII 3'-terminator and upstream of the gIII-3'-promoter.

Some aspects of this invention provide a vector system for continuous evolution procedures, comprising of a viral vector, for example, a selection phage, comprising a multiple cloning site for insertion of a gene to be evolved, a matching accessory plasmid, and a mutagenesis expression construct as described herein. In some embodiments, a vector system for phage-based continuous directed evolution is provided that comprises (a) a selection phage comprising a multiple cloning site for insertion of a gene of interest to be evolved, wherein the phage genome is deficient in at least one gene required to generate infectious phage; (b) an accessory plasmid comprising the at least one gene required to generate infectious phage particle under the control of a conditional promoter that is activated in response to a desired activity of the gene to be evolved; and (c) a mutagenesis expression construct as provided herein. In some embodiments, the mutagenesis expression construct comprises a nucleic acid sequence encoding a gene or combination of genes as listed in Table 2 or FIG. 7. In some embodiments, the mutagenesis expression construct is a mutagenesis plasmid.

In some embodiments, the selection phage is an M13 phage as described herein. For example, in some embodiments, the selection phage comprises an M13 genome including all genes required for the generation of phage particles, for example, gI, gII, gIV, gV, gVI, gVII, gVIII, gIX, and gX gene, but not a full-length gIII gene. In some embodiments, the selection phage genome comprises an F1 or an M13 origin of replication. In some embodiments, the selection phage genome comprises a 3'-fragment of gIII gene. In some embodiments, the selection phage comprises a multiple cloning site upstream of the gIII 3'-promoter and downstream of the gVIII 3'-terminator for insertion of a gene of interest.

The vector system may further comprise a helper phage, wherein the selection phage does not comprise all genes for the generation of infectious phage particles, and wherein the helper phage complements the genome of the selection phage, so that the helper phage genome and the selection phage genome together comprise at least one functional copy of all genes for the generation of phage particles, but are deficient in at least one gene required for the generation of infectious phage particles, which is provided by an accessory plasmid.

Methods

Some aspects of this disclosure provide methods for modulating the mutation rate in a cell, e.g., in a host cell for bacteriophage. In some embodiments, the method comprises contacting the cell with an expression construct or a plasmid as disclosed herein. In some embodiments, the expression construct comprises an inducible promoter, and the method further comprises culturing the host cell under conditions suitable to induce expression from the inducible promoter. In some embodiments, the inducible promoter is an arabinose-inducible promoter, and culturing the host cell under conditions suitable to induce expression from the inducible promoter comprises contacting the host cell with an amount of arabinose sufficient to increase expression of the arabinose-inducible promoter by at least 10-fold, at least 50-fold, at least 100-fold, at least 500-fold, at least 1000-fold, at least 5000-fold, at least 10000-fold, at least 50000-fold, at least 100000-fold, at least 500000-fold, or at least 1000000-fold as compared to basal expression in the absence of arabinose. In some embodiments, the method results in an at least 10-fold, at least 100-fold, at least 1000-fold, at least 10000-fold, at least 15000-fold, at least 200000-fold, at least 250000-fold, or at least 300000-fold increased mutation rate as compared to the mutation rate in the host cell in the absence of the expression construct.

Some aspects of this disclosure provide methods for directed evolution using a mutagenesis expression constructs provided herein. In some embodiments, the method comprises (a) contacting a population of host cells comprising a mutagenesis expression construct or plasmid as provided herein with a population of phage vectors comprising a gene to be evolved and deficient in at least one gene for the generation of infectious phage particles, wherein (1) the host cells are amenable to transfer of the vector; (2) the vector allows for expression of the gene to be evolved in the host cell, can be replicated by the host cell, and the replicated vector can transfer into a second host cell; (3) the host cell expresses a gene product encoded by the at least one gene for the generation of infectious phage particles of (a) in response to the activity of the gene to be evolved, and the level of gene product expression depends on the activity of the gene to be evolved; (b) incubating the population of host cells under conditions allowing for mutation of the gene to be evolved and the transfer of the vector comprising the gene to be evolved from host cell to host cell, wherein host cells are removed from the host cell population, and the population of host cells is replenished with fresh host cells that comprise the expression construct but do not harbor the vector; and (c) isolating a replicated vector from the host cell population in (b), wherein the replicated vector comprises a mutated version of the gene to be evolved.

In some embodiments, the expression construct comprises an inducible promoter, wherein the incubating of (b) comprises culturing the population of host cells under conditions suitable to induce expression from the inducible promoter. In some embodiments, the inducible promoter is an arabinose-inducible promoter, wherein the incubating of (b) comprises contacting the host cell with an amount of arabinose sufficient to increase expression of the arabinose-inducible promoter by at least 10-fold, at least 50-fold, at least 100-fold, at least 500-fold, at least 1000-fold, at least 5000-fold, at least 10000-fold, at least 50000-fold, at least 100000-fold, at least 500000-fold, or at least 1000000-fold as compared to basal expression in the absence of arabinose.

In some embodiments, the vector is a viral vector. In some embodiments, the viral vector is a phage. In some embodiments, the phage is a filamentous phage. In some embodiments, the phage is an M13 phage.

In some embodiments, the at least one gene for the generation of infectious phage particles comprises a sequence encoding a pIII protein. In some embodiments, the at least one gene for the generation of infectious phage particles comprises a full-length gIII gene. In some embodiments, the host cells comprise all phage genes except for the at least one gene for the generation of infectious phage particles in the form of a helper phage. In some embodiments, the phage genes comprised on the helper phage comprise pI, pII, pIV, pV, pVI, pVII, pVIII, pIX, and/or pX.

In some embodiments, the host cells comprise an accessory plasmid. In some embodiments, the accessory plasmid comprises an expression construct encoding the pIII protein under the control of a promoter that is activated by a gene product encoded by the gene to be evolved. In some embodiments, the host cells comprise the accessory plasmid and together, the helper phage and the accessory plasmid comprise all genes required for the generation of an infectious phage. In some embodiments, the method further comprises a negative selection for undesired activity of the gene to be evolved. In some embodiments, the host cells comprise an expression construct encoding a dominant-negative pIII protein (pIII-neg). In some embodiments, expression of the pIII-neg protein is driven by a promoter the activity of which depends on an undesired function of the gene to be evolved.

In some embodiments, step (b) comprises incubating the population of host cells for a time sufficient for at least 10, at least 20, at least 30, at least 40, at least 50, at least 100, at least 200, at least 300, at least 400, at least, 500, at least 600, at least 700, at least 800, at least 900, at least 1000, at least 1250, at least 1500, at least 1750, at least 2000, at least 2500, at least 3000, at least 4000, at least 5000, at least 7500, at least 10000, or more consecutive life cycles of the viral vector or phage. In some embodiments, the host cells are $E.$ $coli$ cells.

In some embodiments, the host cells are incubated in suspension culture. In some embodiments, the population of host cells is continuously replenished with fresh host cells that do not comprise the vector. In some embodiments, fresh cells are being replenished and cells are being removed from the cell population at a rate resulting in a substantially constant number of cells in the cell population. In some embodiments, fresh cells are being replenished and cells are being removed from the cell population at a rate resulting in a substantially constant vector population. In some embodiments, fresh cells are being replenished and cells are being removed from the cell population at a rate resulting in a substantially constant vector, viral, or phage load. In some embodiments, the rate of fresh cell replenishment and/or the rate of cell removal is adjusted based on quantifying the cells in the cell population. In some embodiments, the rate of fresh cell replenishment and/or the rate of cell removal is adjusted based on quantifying the frequency of host cells harboring the vector and/or of host cells not harboring the vector in the cell population. In some embodiments, the quantifying is by measuring the turbidity of the host cell culture, measuring the host cell density, measuring the wet weight of host cells per culture volume, or by measuring light extinction of the host cell culture.

In some embodiments, the host cells are exposed to a mutagen. In some embodiments, the mutagen is ionizing radiation, ultraviolet radiation, base analogs, deaminating agents (e.g., nitrous acid), intercalating agents (e.g., ethidium bromide), alkylating agents (e.g., ethylnitrosourea), transposons, bromine, azide salts, psoralen, benzene, 3-Chloro-4-(dichloromethyl)-5-hydroxy-2(5H)-furanone (MX) (CAS no. 77439-76-0), O,O-dimethyl-S-(phthalimidomethyl)phosphorodithioate (phos-met) (CAS no. 732-11-6), formaldehyde (CAS no. 50-00-0), 2-(2-furyl)-3-(5-nitro-2-furyl)acrylamide (AF-2) (CAS no. 3688-53-7), glyoxal (CAS no. 107-22-2), 6-mercaptopurine (CAS no. 50-44-2), N-(trichloromethylthio)-4-cyclohexane-1,2-dicarboximide (captan) (CAS no. 133-06-2), 2-aminopurine (CAS no. 452-06-2), methyl methane sulfonate (MMS) (CAS No. 66-27-3), 4-nitroquinoline 1-oxide (4-NQO) (CAS No. 56-57-5), N4-Aminocytidine (CAS no. 57294-74-3), sodium azide (CAS no. 26628-22-8), N-ethyl-N-nitrosourea (ENU) (CAS no. 759-73-9), N-methyl-N-nitrosourea (MNU) (CAS no. 820-60-0), 5-azacytidine (CAS no. 320-67-2), cumene hydroperoxide (CHP) (CAS no. 80-15-9), ethyl methanesulfonate (EMS) (CAS no. 62-50-0), N-ethyl-N-nitro-N-nitrosoguanidine (ENNG) (CAS no. 4245-77-6), N-methyl-N-nitro-N-nitrosoguanidine (MNNG) (CAS no. 70-25-7), 5-diazouracil (CAS no. 2435-76-9), or t-butyl hydroperoxide (BHP) (CAS no. 75-91-2).

In some embodiments, the method comprises a phase of diversifying the population of vector by mutagenesis, in which the cells are incubated under conditions suitable for mutagenesis of the gene to be evolved in the absence of stringent selection for vectors having acquired a gain-of-function mutation in the gene to be evolved. In some embodiments, the method comprises a phase of stringent selection for a mutated replication product of the viral vector encoding an evolved gene.

One aspect of the PACE directed evolution methods provided herein is the mutation of the initially provided vectors encoding a gene of interest. In some embodiments, the host cells within the flow of cells in which the vector replicates comprise a mutagenesis expression construct as provided herein and are incubated under conditions that increase the natural (or basal) mutation rate. In embodiments, where the mutagenesis expression construct comprises an inducible promoter (e.g., an arabinose-inducible promoter), this may be achieved by contacting the host cells with a compound activating the inducible promoter (e.g., arabinose), in an amount sufficient to increase the mutation rate in the host cells to a desired level, or to increase the activity of the inducible promoter from a basal level to about 10%, about 20%, about 30%, about 40%, about 50%, about 60%, about 70%, about 80%, or about 90% of its maximum activity, or to fully induce the activity of the inducible promoter.

In some embodiments, the cells are not exposed to an external mutagen (e.g., a chemical mutagen, UV light, or ionizing radiation) during the PACE processes disclosed herein. In other embodiments, however, the host cells are exposed to an external mutagen in order to further increase the mutation rate in the cells. Typically, the concentration of the mutagen will be chosen to maximize the mutation rate while not being toxic to the host cells during the retention time in the lagoon. Ideally, a mutagen is used at a concentration or level of exposure that induces a desired mutation rate in a given host cell or viral vector population, but is not significantly toxic to the host cells used within the average time frame a host cell is exposed to the mutagen or the time a host cell is present in the host cell flow before being replaced by a fresh host cell. In some embodiments, the mutagen is ionizing radiation, ultraviolet radiation, base analogs, deaminating agents (e.g., nitrous acid), intercalating agents (e.g., ethidium bromide), alkylating agents (e.g., ethylnitrosourea), transposons, bromine, azide salts, psoralen, benzene, 3-Chloro-4-(dichloromethyl)-5-hydroxy-2 (5H)-furanone (MX) (CAS no. 77439-76-0), O,O-dimethyl-S-(phthalimidomethyl)phosphorodithioate (phos-met) (CAS no. 732-11-6), formaldehyde (CAS no. 50-00-0), 2-(2-furyl)-3-(5-nitro-2-furyl)acrylamide (AF-2) (CAS no. 3688-53-7), glyoxal (CAS no. 107-22-2), 6-mercaptopurine (CAS no. 50-44-2), N-(trichloromethylthio)-4-cyclohexane-1,2- dicarboximide (captan) (CAS no. 133-06-2), 2-aminopurine (CAS no. 452-06-2), methyl methane sulfonate (MMS) (CAS No. 66-27-3), 4-nitroquinoline 1-oxide (4-NQO) (CAS No. 56-57-5), N4-Aminocytidine (CAS no. 57294-74-3), sodium azide (CAS no. 26628-22-8), N-ethyl-N-nitrosourea (ENU) (CAS no. 759-73-9), N-methyl-N-nitrosourea (MNU) (CAS no. 820-60-0), 5-azacytidine (CAS no. 320-67-2), cumene hydroperoxide (CHP) (CAS no. 80-15-9), ethyl methanesulfonate (EMS) (CAS no. 62-50-0), N-ethyl-N-nitro-N-nitrosoguanidine (ENNG) (CAS no. 4245-77-6), N-methyl-N-nitro-N-nitrosoguanidine (MNNG) (CAS no. 70-25-7), 5-diazouracil (CAS no. 2435-76-9), or t-butyl hydroperoxide (BHP) (CAS no. 75-91-2). Additional suitable mutagens will be known to those of skill in the art, and the disclosure is not limited in this respect.

In some embodiments, the mutation rate of the host cells is increased by contacting the cells with a mutagenesis expression construct as provided herein. In some embodiments, the host cells are contacted with a mutagenesis plasmid. In some embodiments, the mutagenesis plasmid comprises a gene expression cassette encoding a mutagenesis-promoting gene product. In some embodiments, the mutagenesis plasmid comprises a gene expression cassette encoding umuC (a component of E. coli translesion synthesis polymerase V, e.g., as set forth in GenBank M10107.1), dam (deoxyadenosine methylase, e.g., as set forth in GenBank J01600.1), or seqA (a hemimethylated-GATC binding domain, e.g., as set forth in GenBank U07651.1), or any combination thereof. In some embodiments, the mutagenesis plasmid further comprises a nucleic acid encoding UmuD', and/or RecA. In some embodiments, the mutagenesis plasmid comprises a gene expression cassette encoding any combination of genes or gene products provided herein, e.g., as provided in Table 2 or FIG. 7.

In some embodiments, the mutagenesis expression construct comprises an inducible promoter driving expression of at least one mutagenesis-inducing gene or gene product. Suitable inducible promoters are well known to those of skill in the art and include, for example, arabinose-inducible promoters, tetracycline or doxycyclin-inducible promoters, and tamoxifen-inducible promoters. In some embodiments, the host cell population is contacted with an inducer of the inducible promoter in an amount sufficient to effect an increased rate of mutagenesis. For example, in some embodiments, a bacterial host cell population is provided in which the host cells comprise a mutagenesis plasmid in which an expression cassette is controlled by an arabinose-inducible promoter. In some such embodiments, the population of host cells is contacted with the inducer, for example, arabinose, in an amount sufficient to induce a measurably-increased rate of mutation.

The use of an inducible mutagenesis plasmid allows one to generate a population of fresh, uninfected host cells in the absence of the inducer, thus avoiding an increased rate of mutation in the fresh host cells before they are introduced into the population of cells contacted with the viral vector. Once introduced into this population, however, these cells can then be induced to support an increased rate of mutation, which is particularly useful in some embodiments of continuous evolution. For example, in some embodiments, the host cell comprises a mutagenesis plasmid as described herein, which includes an arabinose-inducible promoter driving expression of umuC, dam, and seqA from a pBAD promoter (see, e.g., Khlebnikov A, Skaug T, Keasling J D. *Modulation of gene expression from the arabinose-inducible araBAD promoter*. J Ind Microbiol Biotechnol. 2002 July; 29(1):34-7; incorporated herein by reference for disclosure of a pBAD promoter). In some embodiments, the fresh host cells are not exposed to arabinose, which activates expression of the above-identified genes and, thus, increases the rate of mutations in the arabinose-exposed cells, until the host cells reach the lagoon in which the population of selection phage replicates. Accordingly, in some embodiments, the mutation rate in the host cells is normal until they become part of the host cell population in the lagoon, where they are exposed to the inducer (e.g., arabinose) and, thus, to increased mutagenesis. In some embodiments, a method of continuous evolution is provided that includes a phase of diversifying the population of viral vectors by mutagenesis, in which the cells are incubated under conditions suitable for mutagenesis of the viral vector in the absence of stringent selection for the mutated replication product of the viral vector encoding the evolved protein. This is particularly useful in embodiments in which a desired function to be evolved is not merely an increase in an already present function, but the acquisition of a function not present in the gene to be evolved at the outset of the evolution procedure, such as, for example, recognition of a target promoter by a transcription factor showing no binding activity towards the target promoter in the original version of the transcription factor. A step of diversifying the pool of mutated versions of the gene of interest within the population of viral vectors, for example, of phage, allows for an increase in the chance to find a mutation that conveys the desired function, e.g., new substrate specificity in a transcription factor or enzyme.

In some embodiments, the host cell population is contacted with an agent inducing the expression of an inducible mutagenesis expression construct, such as, for example, arabinose, continuously during a PACE experiment. In other embodiments, the host cell population is contacted with the inducing agent intermittently, creating phases of increased mutagenesis, and accordingly, of increased viral vector diversification. For example, in some embodiments, the host cells are exposed to a concentration of inducing agent sufficient to generate an increased rate of mutagenesis in the gene of interest for about 10%, about 20%, about 30%, about 40%, about 50%, or about 75% of the time. In some embodiments, intermittent exposure to the encoded mutagenesis-increasing gene products can be achieved by using inducible promoters and adding or withdrawing the inducing agent from the host cell culture media during the PACE experiment.

In some embodiments of the provided methods, (1) the host cells are amenable to transfer of the vector encoding the gene to be evolved; (2) the vector allows for expression of the gene of interest in the host cell, can be replicated by the host cell, and the replicated vector can transfer into a second host cell; and (3) the host cell expresses a gene product encoded by the at least one gene for the generation of infectious phage particles (a) in response to the activity of the gene of interest, and the level of gene product expression depends on the activity of the gene of interest. The methods of directed evolution provided herein typically comprise (b) incubating the population of host cells under conditions allowing for mutation of the gene of interest, which may include induction of an inducible promoter driving expression of a nucleic acid sequence encoding one or more mutagenic gene products as provided herein, and the transfer of the vector comprising the gene of interest from host cell to host cell. The host cells are removed from the host cell population at a certain rate, e.g., at a rate that results in an average time a host cell remains in the cell population that is shorter than the average time a host cell requires to divide, but long enough for the completion of a life cycle (uptake, replication, and transfer to another host cell) of the vector.

The population of host cells is replenished with fresh host cells that do not harbor the vector. In some embodiments, the rate of replenishment with fresh cells substantially matches the rate of removal of cells from the cell population, resulting in a substantially constant cell number or cell density within the cell population. The methods of directed evolution provided herein typically also comprise (c) isolating a replicated vector from the host cell population in (b), wherein the replicated vector comprises a mutated version of the gene of interest.

In some embodiments, a gene of interest is transferred from host cell to host cell in a manner dependent on the activity of the gene of interest. In some embodiments, the transfer vector is a virus infecting and replicating in the host cells, for example, a bacteriophage or a retroviral vector. In some embodiments, the viral vector is a phage vector infecting bacterial host cells. In some embodiments, the transfer vector is a retroviral vector, for example, a lentiviral vector or a vesicular stomatitis virus vector, infecting human or mouse cells. In some embodiments, the transfer vector is a conjugative plasmid transferred from a donor bacterial cell to a recipient bacterial cell.

In some embodiments, the nucleic acid vector comprising the gene of interest is a phage, a viral vector, or naked DNA (e.g., a mobilization plasmid). In some embodiments, transfer of the gene of interest from cell to cell is via infection, transfect ion, transduction, conjugation, or uptake of naked DNA, and efficiency of cell-to-cell transfer (e.g., transfer rate) is dependent on an activity of the gene of interest or a mutated version thereof. For example, in some embodiments, the nucleic acid vector is a phage harboring the gene of interest, and the efficiency of phage transfer (via infection) is dependent on the activity of the gene of interest in that a protein for the generation of infectious phage particles (e.g., pIII for M13 phage) is expressed in the host cells only in the presence of a desired activity of the gene of interest.

Some embodiments provide a continuous evolution system, in which a population of viral vectors, e.g., M13 phage vectors, comprising a gene of interest to be evolved replicates in a flow of host cells that comprise a mutagenesis expression construct provided herein, e.g., a flow through a lagoon, wherein the viral vectors are deficient in a gene encoding a protein that is essential for the generation of infectious viral particles, and wherein that gene is in the host cell under the control of a conditional promoter the activity of which depends on the activity of the gene of interest. Suitable methods, vectors, and reagents for linking the activity of a gene of interest to be evolved to expression of a gene encoding a protein that is essential for the generation of infectious viral particles are described, for example, in International PCT Application, PCT/US2009/056194, filed Sep. 8, 2009, published as WO 2010/028347 on Mar. 11, 2010; International PCT Application, PCT/US2011/066747, filed Dec. 22, 2011, published as WO 2012/088381 on Jun. 28, 2012; U.S. Application, U.S. Ser. No. 13/922,812, filed Jun. 20, 2013; and U.S. Application, U.S. Ser. No. 62/067, 194, filed Oct. 22, 2014, the entire contents of each of which are incorporated herein by reference Viral vectors, in which the gene of interest has not acquired a mutation conferring the desired function, will not activate the conditional promoter, or only achieve minimal activation, while any mutation in the gene of interest that confers the desired mutation will result in activation of the conditional promoter. Since the conditional promoter controls an essential protein for the viral life cycle, activation of this promoter directly corresponds to an advantage in viral spread and replication for those vectors that have acquired an advantageous mutation.

In some embodiments, the viral vector comprising the gene of interest is a phage In some embodiments, the phage is a filamentous phage. In some embodiments, the phage is an M13 phage. M13 phages are well known to those in the art and the biology of M13 phages has extensively been studied. A schematic representation of the wild-type M13 genome is provided in FIG. 16. Wild type M13 phage particles comprise a circular, single-stranded genome of approximately 6.4 kb. The wild-type genome includes ten genes, gI-gX, which, in turn, encode the ten M13 proteins, pI-pX, respectively. gVIII encodes pVIII, also often referred to as the major structural protein of the phage particles, while gIII encodes pIII, also referred to as the minor coat protein, which is required for infectivity of M13 phage particles.

The M13 life cycle includes attachment of the phage to the sex pilus of a suitable bacterial host cell via the pIII protein and insertion of the phage genome into the host cell. The circular, single-stranded phage genome is then converted to a circular, double-stranded DNA, also termed the replicative form (RF), from which phage gene transcription is initiated. The wild type M13 genome comprises nine promoters and two transcriptional terminators as well as an origin of replication. This series of promoters provides a gradient of transcription such that the genes nearest the two transcriptional terminators (gVIII and IV) are transcribed at the highest levels. In wild-type M13 phage, transcription of all 10 genes proceeds in same direction. One of the phage-encode proteins, pII, initiates the generation of linear, single-stranded phage genomes in the host cells, which are subsequently circularized, and bound and stabilized by pV. The circularized, single-stranded M13 genomes are then bound by pVIII, while pV is stripped off the genome, which initiates the packaging process. At the end of the packaging process, multiple copies of pIII are attached to wild-type M13 particles, thus generating infectious phage ready to infect another host cell and concluding the life cycle.

The M13 phage genome can be manipulated, for example, by deleting one or more of the wild type genes, and/or inserting a heterologous nucleic acid construct into the genome. M13 does not have stringent genome size restrictions, and insertions of up to 42 kb have been reported. This allows M13 phage vectors to be used in continuous evolution experiments to evolve genes of interest without imposing a limitation on the length of the gene to be involved.

The M13 phage has been well characterized and the genomic sequence of M13 has been reported. Representative M13 genomic sequences can be retrieved from public databases, and an exemplary sequence is provided in entry V00604 of the National Center for Biotechnology Information (NCBI) database (ncbi.nlm.nih.gov):

```
Phage M13 genome:
>gi|56713234|emb|V00604.2| Phage M13 genome
                                                            (SEQ ID NO: 1)
AACGCTACTACTATTAGTAGAATTGATGCCACCTTTTCAGCTCGCGCCCCAAATGAAAATAT

AGCTAAACAGGTTATTGACCATTTGCGAAATGTATCTAATGGTCAAACTAAATCTACTCGTT
```

-continued

CGCAGAATTGGGAATCAACTGTTACATGGAATGAAACTTCCAGACACCGTACTTTAGTTGCA

TATTTAAAACATGTTGAGCTACAGCACCAGATTCAGCAATTAAGCTCTAAGCCATCCGCAAA

AATGACCTCTTATCAAAAGGAGCAATTAAAGGTACTCTCTAATCCTGACCTGTTGGAGTTTG

CTTCCGGTCTGGTTCGCTTTGAAGCTCGAATTAAAACGCGATATTTGAAGTCTTTCGGGCTT

CCTCTTAATCTTTTTGATGCAATCCGCTTTGCTTCTGACTATAATAGTCAGGGTAAAGACCT

GATTTTTGATTTATGGTCATTCTCGTTTTCTGAACTGTTTAAAGCATTTGAGGGGGATTCAA

TGAATATTTATGACGATTCCGCAGTATTGGACGCTATCCAGTCTAAACATTTTACTATTACC

CCCTCTGGCAAAACTTCTTTTGCAAAAGCCTCTCGCTATTTTGGTTTTTATCGTCGTCTGGT

AAACGAGGGTTATGATAGTGTTGCTCTTACTATGCCTCGTAATTCCTTTTGGCGTTATGTAT

CTGCATTAGTTGAATGTGGTATTCCTAAATCTCAACTGATGAATCTTTCTACCTGTAATAAT

GTTGTTCCGTTAGTTCGTTTTATTAACGTAGATTTTTCTTCCCAACGTCCTGACTGGTATAA

TGAGCCAGTTCTTAAAATCGCATAAGGTAATTCACAATGATTAAAGTTGAAATTAAACCATC

TCAAGCCCAATTTACTACTCGTTCTGGTGTTTCTCGTCAGGGCAAGCCTTATTCACTGAATG

AGCAGCTTTGTTACGTTGATTTGGGTAATGAATATCCGGTTCTTGTCAAGATTACTCTTGAT

GAAGGTCAGCCAGCCTATGCGCCTGGTCTGTACACCGTTCATCTGTCCTCTTTCAAAGTTGG

TCAGTTCGGTTCCCTTATGATTGACCGTCTGCGCCTCGTTCCGGCTAAGTAACATGGAGCAG

GTCGCGGATTTCGACACAATTTATCAGGCGATGATACAAATCTCCGTTGTACTTTGTTTCGC

GCTTGGTATAATCGCTGGGGGTCAAAGATGAGTGTTTTAGTGTATTCTTTCGCCTCTTTCGT

TTTAGGTTGGTGCCTTCGTAGTGGCATTACGTATTTTACCCGTTTAATGGAAACTTCCTCAT

GAAAAAGTCTTTAGTCCTCAAAGCCTCTGTAGCCGTTGCTACCCTCGTTCCGATGCTGTCTT

TCGCTGCTGAGGGTGACGATCCCGCAAAAGCGGCCTTTAACTCCCTGCAAGCCTCAGCGACC

GAATATATCGGTTATGCGTGGGCGATGGTTGTTGTCATTGTCGGCGCAACTATCGGTATCAA

GCTGTTTAAGAAATTCACCTCGAAAGCAAGCTGATAAACCGATACAATTAAAGGCTCCTTTT

GGAGCCTTTTTTTTTGGAGATTTTCAACATGAAAAAATTATTATTCGCAATTCCTTTAGTTG

TTCCTTTCTATTCTCACTCCGCTGAAACTGTTGAAAGTTGTTTAGCAAAACCCCATACAGAA

AATTCATTTACTAACGTCTGGAAAGACGACAAAACTTTAGATCGTTACGCTAACTATGAGGG

TTGTCTGTGGAATGCTACAGGCGTTGTAGTTTGTACTGGTGACGAAACTCAGTGTTACGGTA

CATGGGTTCCTATTGGGCTTGCTATCCCTGAAAATGAGGGTGGTGGCTCTGAGGGTGGCGGT

TCTGAGGGTGGCGGTTCTGAGGGTGGCGGTACTAAACCTCCTGAGTACGGTGATACACCTAT

TCCGGGCTATACTTATATCAACCCTCTCGACGGCACTTATCCGCCTGGTACTGAGCAAAACC

CCGCTAATCCTAATCCTTCTCTTGAGGAGTCTCAGCCTCTTAATACTTTCATGTTTCAGAAT

AATAGGTTCCGAAATAGGCAGGGGGCATTAACTGTTTATACGGGCACTGTTACTCAAGGCAC

TGACCCCGTTAAAACTTATTACCAGTACACTCCTGTATCATCAAAAGCCATGTATGACGCTT

ACTGGAACGGTAAATTCAGAGACTGCGCTTTCCATTCTGGCTTTAATGAGGATCCATTCGTT

TGTGAATATCAAGGCCAATCGTCTGACCTGCCTCAACCTCCTGTCAATGCTGGCGGCGGCTC

TGGTGGTGGTTCTGGTGGCGGCTCTGAGGGTGGTGGCTCTGAGGGTGGCGGTTCTGAGGGTG

GCGGCTCTGAGGGAGGCGGTTCCGGTGGTGGCTCTGGTTCCGGTGATTTTGATTATGAAAAG

ATGGCAAACGCTAATAAGGGGGCTATGACCGAAAATGCCGATGAAAACGCGCTACAGTCTGA

CGCTAAAGGCAAACTTGATTCTGTCGCTACTGATTACGGTGCTGCTATCGATGGTTTCATTG

GTGACGTTTCCGGCCTTGCTAATGGTAATGGTGCTACTGGTGATTTTGCTGGCTCTAATTCC

CAAATGGCTCAAGTCGGTGACGGTGATAATTCACCTTTAATGAATAATTTCCGTCAATATTT

```
ACCTTCCCTCCCTCAATCGGTTGAATGTCGCCCTTTTGTCTTTAGCGCTGGTAAACCATATG

AATTTTCTATTGATTGTGACAAAATAAACTTATTCCGTGGTGTCTTTGCGTTTCTTTTATAT

GTTGCCACCTTTATGTATGTATTTTCTACGTTTGCTAACATACTGCGTAATAAGGAGTCTTA

ATCATGCCAGTTCTTTTGGGTATTCCGTTATTATTGCGTTTCCTCGGTTTCCTTCTGGTAAC

TTTGTTCGGCTATCTGCTTACTTTTCTTAAAAAGGGCTTCGGTAAGATAGCTATTGCTATTT

CATTGTTTCTTGCTCTTATTATTGGGCTTAACTCAATTCTTGTGGGTTATCTCTCTGATATT

AGCGCTCAATTACCCTCTGACTTTGTTCAGGGTGTTCAGTTAATTCTCCCGTCTAATGCGCT

TCCCTGTTTTTATGTTATTCTCTCTGTAAAGGCTGCTATTTTCATTTTTGACGTTAAACAAA

AAATCGTTTCTTATTTGGATTGGGATAAATAATATGGCTGTTTATTTTGTAACTGGCAAATT

AGGCTCTGGAAAGACGCTCGTTAGCGTTGGTAAGATTCAGGATAAAATTGTAGCTGGGTGCA

AAATAGCAACTAATCTTGATTTAAGGCTTCAAAACCTCCCGCAAGTCGGGAGGTTCGCTAAA

ACGCCTCGCGTTCTTAGAATACCGGATAAGCCTTCTATATCTGATTTGCTTGCTATTGGGCG

CGGTAATGATTCCTACGATGAAAATAAAAACGGCTTGCTTGTTCTCGATGAGTGCGGTACTT

GGTTTAATACCCGTTCTTGGAATGATAAGGAAAGACAGCCGATTATTGATTGGTTTCTACAT

GCTCGTAAATTAGGATGGGATATTATTTTTCTTGTTCAGGACTTATCTATTGTTGATAAACA

GGCGCGTTCTGCATTAGCTGAACATGTTGTTTATTGTCGTCGTCTGGACAGAATTACTTTAC

CTTTTGTCGGTACTTTATATTCTCTTATTACTGGCTCGAAAATGCCTCTGCCTAAATTACAT

GTTGGCGTTGTTAAATATGGCGATTCTCAATTAAGCCCTACTGTTGAGCGTTGGCTTTATAC

TGGTAAGAATTTGTATAACGCATATGATACTAAACAGGCTTTTTCTAGTAATTATGATTCCG

GTGTTTATTCTTATTTAACGCCTTATTTATCACACGGTCGGTATTTCAAACCATTAAATTTA

GGTCAGAAGATGAAATTAACTAAAATATATTTGAAAAAGTTTTCTCGCGTTCTTTGTCTTGC

GATTGGATTTGCATCAGCATTTACATATAGTTATATAACCCAACCTAAGCCGGAGGTTAAAA

AGGTAGTCTCTCAGACCTATGATTTTGATAAATTCACTATTGACTCTTCTCAGCGTCTTAAT

CTAAGCTATCGCTATGTTTTCAAGGATTCTAAGGGAAAATTAATTAATAGCGACGATTTACA

GAAGCAAGGTTATTCACTCACATATATTGATTTATGTACTGTTTCCATTAAAAAAGGTAATT

CAAATGAAATTGTTAAATGTAATTAATTTTGTTTTCTTGATGTTTGTTTCATCATCTTCTTT

TGCTCAGGTAATTGAAATGAATAATTCGCCTCTGCGCGATTTTGTAACTTGGTATTCAAAGC

AATCAGGCGAATCCGTTATTGTTTCTCCCGATGTAAAAGGTACTGTTACTGTATATTCATCT

GACGTTAAACCTGAAAATCTACGCAATTTCTTTATTTCTGTTTTACGTGCTAATAATTTTGA

TATGGTTGGTTCAATTCCTTCCATAATTCAGAAGTATAATCCAAACAATCAGGATTATATTG

ATGAATTGCCATCATCTGATAATCAGGAATATGATGATAATTCCGCTCCTTCTGGTGGTTTC

TTTGTTCCGCAAAATGATAATGTTACTCAAACTTTTAAAATTAATAACGTTCGGGCAAGGA

TTTAATACGAGTTGTCGAATTGTTTGTAAAGTCTAATACTTCTAAATCCTCAAATGTATTAT

CTATTGACGGCTCTAATCTATTAGTTGTTAGTGCACCTAAAGATATTTTAGATAACCTTCCT

CAATTCCTTTCTACTGTTGATTTGCCAACTGACCAGATATTGATTGAGGGTTTGATATTTGA

GGTTCAGCAAGGTGATGCTTTAGATTTTTCATTTGCTGCTGGCTCTCAGCGTGGCACTGTTG

CAGGCGGTGTTAATACTGACCGCCTCACCTCTGTTTTATCTTCTGCTGGTGGTTCGTTCGGT

ATTTTTAATGGCGATGTTTTAGGGCTATCAGTTCGCGCATTAAAGACTAATAGCCATTCAAA

AATATTGTCTGTGCCACGTATTCTTACGCTTTCAGGTCAGAAGGGTTCTATCTCTGTTGGCC

AGAATGTCCCTTTTATTACTGGTCGTGTGACTGGTGAATCTGCCAATGTAAATAATCCATTT
```

-continued

```
CAGACGATTGAGCGTCAAAATGTAGGTATTTCCATGAGCGTTTTTCCTGTTGCAATGGCTGG

CGGTAATATTGTTCTGGATATTACCAGCAAGGCCGATAGTTTGAGTTCTTCTACTCAGGCAA

GTGATGTTATTACTAATCAAAGAAGTATTGCTACAACGGTTAATTTGCGTGATGGACAGACT

CTTTTACTCGGTGGCCTCACTGATTATAAAAACACTTCTCAAGATTCTGGCGTACCGTTCCT

GTCTAAAATCCCTTTAATCGGCCTCCTGTTTAGCTCCCGCTCTGATTCCAACGAGGAAAGCA

CGTTATACGTGCTCGTCAAAGCAACCATAGTACGCGCCCTGTAGCGGCGCATTAAGCGCGGC

GGGTGTGGTGGTTACGCGCAGCGTGACCGCTACACTTGCCAGCGCCCTAGCGCCCGCTCCTT

TCGCTTTCTTCCCTTCCTTTCTCGCCACGTTCGCCGGCTTTCCCCGTCAAGCTCTAAATCGG

GGGCTCCCTTTAGGGTTCCGATTTAGTGCTTTACGGCACCTCGACCCCAAAAAACTTGATTT

GGGTGATGGTTCACGTAGTGGGCCATCGCCCTGATAGACGGTTTTTCGCCCTTTGACGTTGG

AGTCCACGTTCTTTAATAGTGGACTCTTGTTCCAAACTGGAACAACACTCAACCCTATCTCG

GGCTATTCTTTTGATTTATAAGGGATTTTGCCGATTTCGGCCTATTGGTTAAAAAATGAGCT

GATTTAACAAAAATTTAACGCGAATTTTAACAAAATATTAACGTTTACAATTTAAATATTTG

CTTATACAATCTTCCTGTTTTGGGGCTTTTCTGATTATCAACCGGGGTACATATGATTGAC

ATGCTAGTTTTACGATTACCGTTCATCGATTCTCTTGTTTGCTCCAGACTCTCAGGCAATGA

CCTGATAGCCTTTGTAGACCTCTCAAAAATAGCTACCCTCTCCGGCATGAATTTATCAGCTA

GAACGGTTGAATATCATATTGATGGTGATTTGACTGTCTCCGGCCTTTCTCACCCTTTTGAA

TCTTTACCTACACATTACTCAGGCATTGCATTTAAAATATATGAGGGTTCTAAAAATTTTTA

TCCTTGCGTTGAAATAAAGGCTTCTCCCGCAAAAGTATTACAGGGTCATAATGTTTTTGGTA

CAACCGATTTAGCTTTATGCTCTGAGGCTTTATTGCTTAATTTTGCTAATTCTTTGCCTTGC

CTGTATGATTTATTGGATGTT
```

GENE II: join (6006..6407,1..831)
(SEQ ID NO: 2)
translation = MIDMLVLRLPFIDSLVCSRLSGNDLIAFVDLSKIATLSGMNLSARTVEYHIDGD

LTVSGLSHPFESLPTHYSGIAFKIYEGSKNFYPCVEIKASPAKVLQGHNVFGTTDLALCSEA

LLLNFANSLPCLYDLLDVNATTISRIDATFSARAPNENIAKQVIDHLRNVSNGQTKSTRSQN

WESTVTWNETSRHRTLVAYLKHVELQHQIQQLSSKPSAKMTSYQKEQLKVLSNPDLLEFASG

LVRFEARIKTRYLKSFGLPLNLFDAIRFASDYNSQGKDLIFDLWSFSFSELFKAFEGDSMNI

YDDSAVLDAIQSKHFTITPSGKTSFAKASRYFGFYRRLVNEGYDSVALTMPRNSFWRYVSAL

VECGIPKSQLMNLSTCNNVVPLVRFINVDFSSQRPDWYNEPVLKIA

GENE X: 496..831
(SEQ ID NO: 3)
translation = MNIYDDSAVLDAIQSKHFTITPSGKTSFAKASRYFGFYRRLVNEGYDSVALTMP
RNSFWRYVSALVECGIPKSQLMNLSTCNNVVPLVRFINVDFSSQRPDWYNEPVLKIA GENE V:843..1106
(SEQ ID NO: 4)
translation = MIKVEIKPSQAQFTTRSGVSRQGKPYSLNEQLCYVDLGNEYPVLVKITLDEGQP
AYAPGLYTVHLSSFKVGQFGSLMIDRLRLVPAK GENE VII: 1108..1209
(SEQ ID NO: 5)
translation = MEQVADFDTIYQAMIQISVVLCFALGIIAGGQR GENE IX: 1206..1304
(SEQ ID NO: 6)
translation = MSVLVYSFASFVLGWCLRSGITYFTRLMETSS -continued

GENE VIII: 1301..1522

(SEQ ID NO: 7)
translation = MKKSLVLKASVAVATLVPMLSFAAEGDDPAKAAFNSLQASATEYIGYAWAMVVV
IVGATIGIKLFKKFTSKAS

GENE III: 1579..2853

(SEQ ID NO: 8)
translation = MKKLLFAPLVVPFYSHSAETVESCLAKPHTENSFINVWKDDKILDRYANYEGC

LWNATGVVVCTGDETQCYGTWVPIGLAIPENEGGGSEGGGSEGGGSEGGGTKPPEYGDTPIP

GYTYINPLDGTYPPGTEQNPANPNPSLEESQPLNTFMFQNNRFRNRQGALTVYTGTVTQGTD

PVKTYYQYTPVSSKAMYDAYWNGKFRDCAFHSGFNEDPFVCEYQGQSSDLPQPPVNAGGGSG

GGSGGGSEGGGSEGGGSEGGGSEGGGSGGGSGSGDFDYEKMANANKGAMTENADENALQSDA

KGKLDSVATDYGAAIDGFIGDVSGLANGNGATGDFAGSNSQMAQVGDGDNSPLMNNFRQYLP

SLPQSVECRPFVFSAGKPYEFSIDCDKINLFRGVFAFLLYVATFMYVFSTFANILRNKES

GENE VI: 2856..3194

(SEQ ID NO: 9)
translation = MPVLLGIPLLLRFLGFLLVTLFGYLLTFLKKGFGKIAIAISLFLALIIGLNSIL
VGYLSDISAQLPSDFVQGVQLILPSNALPCFYVILSVKAAIFIFDVKQKIVSYLDWDK

GENE I: 3196..4242

(SEQ ID NO: 10)
translation = MAVYFVTGKLGSGKTLVSVGKIQDKIVAGCKIATNLDLRLQNLPQVGRFAKTPR

VLRIPDKPSISDLLAIGRGNDSYDENKNGLLVLDECGTWFNTRSWNDKERQPIIDWFLHARK

LGWDIIFLVQDLSIVDKQARSALAEHVVYCRRLDRITLPFVGTLYSLITGSKMPLPKLHVGV

VKYGDSQLSPTVERWLYTGKNLYNAYDTKQAFSSNYDSGVYSYLTPYLSHGRYFKPLNLGQK

MKLTKIYLKKFSRVLCLAIGFASAFTYSYITQPKPEVKKVVSQTYDFDKFTIDSSQRLNLSY

RYVFKDSKGKLINSDDLQKQGYSLTYIDLCTVSIKKGNSNEIVKCN

GENE IV: 4220..5500

(SEQ ID NO: 11)
translation = MKLLNVINFVFLMFVSSSSFAQVIEMNNSPLRDFVTWYSKQSGESVIVSPDVKG

TVTVYSSDVKPENLRNFFISVLRANNFDMVGSIPSIIQKYNPNNQDYIDELPSSDNQEYDDN

SAPSGGFFVPQNDNVTQTFKINNVRAKDLIRVVELFVKSNTSKSSNVLSIDGSNLLVVSAPK

DILDNLPQFLSTVDLPTDQILIEGLIFEVQQGDALDFSFAAGSQRGTVAGGVNTDRLTSVLS

SAGGSFGIFNGDVLGLSVRALKTNSHSKILSVPRILTLSGQKGSISVGQNVPFITGRVTGES

ANVNNPFQTIERQNVGISMSVFPVAMAGGNIVLDITSKADSLSSSTQASDVITNQRSIATTV

NLRDGQTLLLGGLTDYKNTSQDSGVPFLSKIPLIGLLFSSRSDSNEESTLYVLVKATIVRAL

Some embodiments of the PACE technology described herein utilize a "selection phage," a modified phage that comprises a gene of interest to be evolved and lacks a full-length gene encoding a protein required for the generation of infectious phage particles. In some such embodiments, the selection phage serves as the vector that replicates and evolves in the flow of host cells. For example, some M13 selection phages provided herein comprise a nucleic acid sequence encoding a gene to be evolved, e.g., under the control of an M13 promoter, and lack all or part of a phage gene encoding a protein required for the generation of infectious phage particles, e.g., gI, gII, gIII, gIV, gV, gVI, gVII, gVIII, gIX, or gX, or any combination thereof. For example, some M13 selection phages provided herein comprise a nucleic acid sequence encoding a gene product, e.g., a transcript or a protein, to be evolved, e.g., under the control of an M13 promoter, and lack all or part of a gene encoding a protein required for the generation of infective phage particles, e.g., the gIII gene encoding the pIII protein. An exemplary, non-limiting selection plasmid sequence, SP-MCS, comprising a multiple cloning site, into which a nucleic acid sequence encoding a gene product to be evolved can be cloned, is provided below:

(SEQ ID NO: 30)
ATGATTGACATGCTAGTTTTACGATTACCGTTCATCGATTCTCTTGTTT

GCTCCAGACTCTCAGGCAATGACCTGATAGCCTTTGTAGACCTCTCAAA

AATAGCTACCCTCTCCGGCATGAATTTATCAGCTAGAACGGTTGAATAT

CATGTTGATGGTGATTTGACTGTCTCCGGCCTTTCTCACCCTTTTGAAT

CTTTACCTACACATTACTCAGGCATTGCATTTAAAATATATGAGGGTTC

TAAAAATTTTTATCCTTGCGTTGAAATAAAGGCTTCTCCCGCAAAAGTA

TTACAGGGTCATAATGTTTTTGGTACAACCGATTTAGCTTTATGCTCTG

AGGCTTTATTGCTTAATTTTGCTAATTCTTTGCCTTGCCTGTATGATTT

ATTGGATGTTAACGCTACTACTATTAGTAGAATTGATGCCACCTTTTCA

GCTCGCGCCCCAAATGAAAATATAGCTAAACAGGTTATTGACCATTTGC
GAAATGTATCTAATGGTCAAACTAAATCTACTCGTTCGCAGAATTGGGA
ATCAACTGTTACATGGAATGAAACTTCCAGACACCGTACTTTAGTTGCA
TATTTAAAACATGTTGAGCTACAGCACCAGATTCAGCAATTAAGCTCTA
AGCCATCCGCAAAAATGACCTCTTATCAAAAGGAGCAATTAAAGGTACT
CTCTAATCCTGACCTGTTGGAGTTTGCTTCCGGGCTGGTTCGCTTTGAA
GCTCGAATTAGAACGCGATATTTGAAGTCTTTCGGGCTTCCTCTTAATC
TTTTTGATGCAATCCGCTTTGCTTCTGACTATAATAGTCAGGGTAAAGA
CCTGATTTTTGATTTATGGTCATTCTCGTTTTCTGAACTGTTTAAAGCA
TTTGAGGGGGATTCAATGAATATTTATGACGATTCCGCAGTATTGGACG
CTATCCAGTCTAAACATTTTACTATTACCCCCTCTGGCAAAACTTCTTT
TGCAAAAGCCTCTCGCTATTTTGGTTTTTATCGTCGTCTGGTAAACGAG
GGTTATGATAGTGTTGCTCTTACTATGCCTCGTAATTCCTTTTGGCGTT
ATGTATCTGCATTAGTTGAATGTGGTATTCCTAAATCTCAACTGATGAA
TCTTTCTACCTGTAATAATGTTGTTCCGTTAGTTCGTTTTATTAACGTA
GATTTTTCTTCCCAACGTCCTGACTGGTATAATGAGCCAGTTCTTAAAA
TCGCATAAGGTAATTCACAATGATTAAAGTTGAAATTAAACCATCTCAA
GCCCAATTTACTACTCGTTCTGGTGTTTCTCGTCAGGGCAAGCCTTATT
CACTGAATGAGCAGCTTTGTTACGTTGATTTGGGTAATGAATATCCGGT
TCTTGTCAAGATTACTCTTGATGAAGGTCAGCCAGCCTATGCGCCTGGT
CTGTACACCGTTCATCTGTCCTCTTTCAAAGTTGGTCAGTTCGGTTCCC
TTATGATTGACCGTCTGCGCCTCGTTCCGGCTAAGTAACATGGAGCAGG
TCGCGGATTTCGACACAATTTATCAGGCGATGATACAAATCTCCGTTGT
ACTTTGTTTCGCGCTTGGTATAATCGCTGGGGGTCAAAGATGAGTGTTT
TAGTGTATTCTTTCGCCTCTTTCGTTTTAGGTTGGTGCCTTCGTAGTGG
CATTACGTATTTTACCCGTTTAATGGAAACTTCCTCATGAAAAAGTCTT
TAGTCCTCAAAGCCTCTGTAGCCGTTGCTACCCTCGTTCCGATGCTGTC
TTTCGCTGCTGAGGGTGACGATCCCGCAAAAGCGGCCTTTAACTCCCTG
CAAGCCTCAGCGACCGAATATATCGGTTATGCGTGGGCGATGGTTGTTG
TCATTGTCGGCGCAACTATCGGTATCAAGCTGTTTAAGAAATTCACCTC
GAAAGCAAGCTGATAAACCGATACAATTAAAGGCTCCTTTTGGAGCCTT
TTTTTTCGCGCCAGAAGGAGACCAAGCTTGCATGCCTGCAGGTCGACTC
TAGAGGATCCCCGGGTACCGAGCTCGAATTCTGGAGATTTTCAACATGC
TCCCTCAATCGGTTGAATGTCGCCCTTTTGTCTTTAGCGCTGGTAAACC
ATATGAATTTTCTATTGATTGTGACAAAATGAACTTATTCCGTGGTGTC
TTTGCGTTTCTTTTATATGTTGCCACCTTTATGTATGTATTTTCTACGT
TTGCTAACATACTGCGTAATAAGGAGTCTTAATCATGCCAGTTCTTTTG
GGTATTCCGTTATTATTGCGTTTCCTCGGTTTCCTTCTGGTAACTTTGT
TCGGCTATCTGCTTACTTTCTTAAAAAGGGCTTCGGTAAGATAGCTAT
TGCTATTTCATTGTTTCTTGCTCTTATTATTGGGCTTAACTCAATTCTT

GTGGGTTATCTCTCTGATATTAGCGCTCAATTACCCTCTGACTTTGTTC
AGGGTGTTCAGTTAATTCTCCCGTCTAATGCGCTTCCCTGTTTTTATGT
TATTCTCTCTGTAAAGGCTGCTATTTTCATTTTTGACGTTAAACAAAAA
ATCGTTTCTTATTTGGATTGGGATAAATAATATGGCTGTTTATTTTGTA
ACTGGCAAATTAGGCTCTGGAAAGACGCTCGTTAGCGTTGGTAAGATTC
AGGATAAAATTGTAGCTGGGTGCAAAATAGCAACTAATCTTGATTTAAG
GCTTCAAAACCTCCCGCAAGTCGGGAGGTTCGCTAAAACGCCTCGCGTT
CTTAGAATACCGGATAAGCCTTCTATATCTGATTTGCTTGCTATTGGGC
GCGGTAATGATTCCTACGATGAAAATAAAAACGGCTTGCTTGTTCTCGA
TGAGTGCGGTACTTGGTTTAATACCCGTTCTTGGAATGATAAGGAAAGA
CAGCCGATTATTGATTGGTTTCTACATGCTCGTAAATTAGGATGGGATA
TTATTTTTCTTGTTCAGGACTTATCTATTGTTGATAAACAGGCGCGTTC
TGCATTAGCTGAACATGTTGTTTATTGTCGTCGTCTGGACAGAATTACT
TTACCTTTTGTCGGTACTTTATATTCTCTTATTACTGGCTCGAAAATGC
CTCTGCCTAAATTACATGTTGGCGTTGTTAAATATGGCGATTCTCAATT
AAGCCCTACTGTTGAGCGTTGGCTTTATACTGGTAAGAATTTGTATAAC
GCATATGATACTAAACAGGCTTTTTCTAGTAATTATGATTCCGGTGTTT
ATTCTTATTTAACGCCTTATTTATCACACGGTCGGTATTTCAAACCATT
AAATTTAGGTCAGAAGATGAAATTAACTAAAATATATTTGAAAAGTTT
TCTCGCGTTCTTTGTCTTGCGATTGGATTTGCATCAGCATTTACATATA
GTTATATAACCCAACCTAAGCCGGAGGTTAAAAAGGTAGTCTCTCAGAC
CTATGATTTTGATAAATTCACTATTGACTCTTCTCAGCGTCTTAATCTA
AGCTATCGCTATGTTTTCAAGGATTCTAAGGGAAAATTAATTAATAGCG
ACGATTTACAGAAGCAAGGTTATTCACTCACATATATTGATTTATGTAC
TGTTTCCATTAAAAAAGGTAATTCAAATGAAATTGTTAAATGTAATTAA
TTTTGTTTTCTTGATGTTTGTTTCATCATCTTCTTTTGCTCAGGTAATT
GAAATGAATAATTCGCCTCTGCGCGATTTTGTAACTTGGTATTCAAAGC
AATCAGGCGAATCCGTTATTGTTTCTCCCGATGTAAAAGGTACTGTTAC
TGTATATTCATCTGACGTTAAACCTGAAAATCTACGCAATTTCTTTATT
TCTGTTTTACGTGCAAGTAATTTTGATATGGTTGGTTCTAACCCTTCCA
TTATTCAGAAGTATAATCCAAACAATCAGGATTATATTGATGAATTGCC
ATCATCTGATAATCAGGAATATGATGATAATTCCGCTCCTTCTGGTGGT
TTCTTTGTTCCGCAAAATGATAATGTTACTCAAACTTTTAAAATTAATA
ACGTTCGGGCAAAGGATTTAATACGAGTTGTCGAATTGTTTGTAAAGTC
TAATACTTCTAAATCCTCAAATGTATTATCTATTGACGGCTCTAATCTA
TTAGTTGTTAGTGCACCTAAAGATATTTTAGATAACCTTCCTCAATTCC
TTTCTACTGTTGATTTGCCAACTGACCAGATATTGATTGAGGGTTTGAT
ATTTGAGGTTCAGCAAGGTGATGCTTTAGATTTTTCATTTGCTGCTGGC
TCTCAGCGTGGCACTGTTGCAGGCGGTGTTAATACTGACCGCCTCACCT
CTGTTTTATCTTCTGCTGGTGGTTCGTTCGGTATTTTTAATGGCGATGT
TTTAGGGCTATCAGTTCGCGCATTAAAGACTAATAGCCATTCAAAAATA

-continued

```
TTGTCTGTGCCACGTATTCTTACGCTTTCAGGTCAGAAGGGTTCTATCT

TTGTTGGCCAGAATGTCCCTTTTATTACTGGTCGTGTGACTGGTGAATC

TGCCAATGTAAATAATCCATTTCAGACGATTGAGCGTCAAAATGTAGGT

ATTTCCATGAGCGTTTTTCCTGTTGCAATGGCTGGCGGTAATATTGTTC

TGGATATTACCAGCAAGGCCGATAGTTTGAGTTCTTCTACTCAGGCAAG

TGATGTTATTACTAATCAAAGAAGTACTGCTACAACGGTTAATTTGCGT

GATGGACAGACTCTTTTACTCGGTGGCCTCACTGATTATAAAAACACTT

CTCAGGATTCTGGCGTACCGTTCCTGTCTAAAATCCCTTTAATCGGCCT

CCTGTTTAGCTCCCGCTCTGATTCTAACGAGGAAAGCACGTTATACGTG

CTCGTCAAAGCAACCATAGTACGCGCCCTGTAGCGGCGCATTAAGCGCG

GCGGGTGTGGTGGTTACGCGCAGCGTGACCGCTACACTTGCCAGCGCCC

TAGCGCCCGCTCCTTTCGCTTTCTTCCCTTCCTTTCTCGCCACGTTCGC

CGGCTTTCCCCGTCAAGCTCTAAATCGGGGGCTCCCTTTAGGGTTCCGA

TTTAGTGCTTTACGGCACCTCGACCCCAAAAAACTTGATTTGGGTGATG

GTTCACGTAGTGGGCCATCGCCCTGATAGACGGTTTTTCGCCCTTTGAC

GTTGGAGTCCACGTTCTTTAATAGTGGACTCTTGTTCCAAACTGGAACA

ACACTCAACCCTATCTCGGGCTATTCTTTTGATTTATAAGGGATTTTGC

CGATTTCGGCCTATTGGTTAAAAAATGAGCTGATTTAACAAAAATTTAA

CGCGAATTTTAACAAAATATTAACGTTTACAATTTAAATATTTGCTTAT

ACAATCTTCCTGTTTTTGGGGCTTTTCTTATTATCAACCGGGGTACAT
```

In some embodiments, the directed evolution methods provided herein comprise an initial or intermittent phase of diversifying the population of vectors by mutagenesis, in which the cells are incubated under conditions suitable for mutagenesis of the gene of interest in the absence of stringent selection or in the absence of any selection for evolved variants of the gene to be evolved that have acquired a desired activity. Such low-stringency selection or no selection periods may be achieved by supporting expression of the gene for the generation of infectious phage particles in the absence of desired activity of the gene to be evolved, for example, by providing an inducible expression construct comprising a gene encoding the respective phage packaging protein under the control of an inducible promoter and incubating under conditions that induce expression of the promoter, e.g., in the presence of the inducing agent. Suitable inducible promoters and inducible expression systems are described herein and in International PCT Application, PCT/US2011/066747, filed Dec. 22, 2011, published as WO 2012/088381 on Jun. 28, 2012; and U.S. Application, U.S. Ser. No. 13/922,812, filed Jun. 20, 2013, the entire contents of each of which are incorporated herein by reference. Additional suitable promoters and inducible gene expression systems will be apparent to those of skill in the art based on the instant disclosure. In some embodiments, the method comprises a phase of stringent selection for a mutated version of the gene to be evolved. If an inducible expression system is used to relieve selective pressure, the stringency of selection can be increased by removing the inducing agent from the population of cells in the lagoon, thus turning expression from the inducible promoter off, so that any expression of the gene required for the generation of infectious phage particles must come from the expression system that depends on the activity of the gene product to be evolved, e.g., the conditional promoter-controlled version of the gene required for the generation of infectious phage particles comprised in an accessory plasmid.

In some embodiments, the link between desired gene product activity and selective advantage for an encoding phage is provided by an expression system in which at least one gene for the generation of infectious phage particles is expressed in response to the desired activity of the gene to be evolved as described in more detail elsewhere herein. In some embodiments, the at least one gene for the generation of infectious phage particles to another host cell is a gene required for the production of infectious phage particles. In some embodiments, the vector is M13 phage, and the at least one gene for the generation of infectious phage particles comprises a full-length M13 pIII gene. In some embodiments, the host cells comprise an accessory plasmid comprising an expression construct encoding the at least one gene for the generation of infectious phage particles, e.g., the full-length pIII protein, under the control of a conditional promoter that is activated by a desired function of the gene to be evolved.

In some embodiments, the conditional promoter of the accessory plasmid is a promoter, the transcriptional activity of which can be regulated over a wide range, for example, over 2, 3, 4, 5, 6, 7, 8, 9, or 10 orders of magnitude by the activating function, for example, the function of a gene of interest. In some embodiments, the conditional promoter has a basal activity that allows for baseline packaging of viral vectors even in the absence of the desired activity of the gene to be evolved or in the presence of only minimal desired activity of the gene to be evolved. This allows for starting a continuous evolution process with a viral vector population comprising versions of the gene of interest that only show minimal activation of the conditional promoter, e.g., of a wild-type version of the gene of interest. In the process of continuous evolution, any mutation in the gene of interest that increases activity of the conditional promoter directly translates into higher expression levels of the gene required for the generation of infectious viral particles in the host cells harboring the vector comprising such a mutation, and, thus, into a competitive advantage over other viral vectors carrying minimally active or loss-of-function versions of the gene of interest.

One function of the accessory plasmid is to provide a gene for the generation of infectious phage particles under the control of a conditional promoter the activity of which depends on a function of the gene of interest. Accordingly, the accessory plasmid provides a selection mechanism that favors desirable mutations over inconsequential mutations or mutations that are detrimental to the desired function. The stringency of selective pressure imposed by the accessory plasmid in a continuous evolution procedure as provided herein can be modulated. For example, an accessory plasmid may be used at different copy numbers per cell, may comprise a conditional promoter having a base line transcription rate ("leakiness") that prevents washout of unmutated sequences from the lagoon while still providing a selective advantage to desirable mutations. In some embodiments, an accessory plasmid comprising an expression cassette in which the gene for the generation of infectious phage particles is under the control of an inducible promoter that can be activated by a chemical compound (e.g., a tet-on promoter), allowing for titration of the expression of the gene for the generation of infectious phage particles during a continuous evolution experiment.

In some embodiments, the use of low copy number accessory plasmids results in an elevated stringency of selection for versions of the gene of interest that activate the conditional promoter on the accessory plasmid, while the use of high copy number accessory plasmids results in a lower stringency of selection. The copy number of an accessory plasmid will depend to a large part on the origin of replication employed. Those of skill in the art will be able to determine suitable origins of replication in order to achieve a desired copy number. The following table lists some non-limiting examples of vectors of different copy numbers and with different origins of replication:

| Plasmids | Origin of Replication | Copy number | Class |
| --- | --- | --- | --- |
| pUC vectors | pMB1* | 500-700 | high copy |
| pBluescript ® vectors | ColE1 | 300-500 | high copy |
| pGEM ® vectors | pMB1* | 300-400 | high copy |
| pTZ vectors | pMB1* | >1000 | high copy |
| pBR322 and derivatives | pMB1* | 15-20 | low copy |
| pACYC and derivatives | p15A | 10-12 | low copy |
| pSC101 and derivatives | pSC101 | ~5 | very low copy |

*The pMB1 origin of replication is closely related to that of ColE1 and falls in the same incompatibility group. The high-copy plasmids listed here contain mutated versions of this origin.

It should be understood that one function of the accessory plasmid, namely to provide a gene for the generation of infectious phage particles under the control of a conditional promoter, the activity of which depends on a function of the gene of interest, can be conferred to a host cell in alternative ways. Such alternatives include, but are not limited to, permanent insertion of a gene construct comprising the conditional promoter and the respective gene into the genome of the host cell, or introducing it into the host cell using a different vector, for example, a phagemid, a cosmid, a phage, a virus, or an artificial chromosome. Additional ways to confer accessory plasmid function to host cells will be evident to those of skill in the art, and the invention is not limited in this respect.

The sequences of two exemplary, non-limiting accessory plasmids, AP-MCS-A, and AP-MCS-P, respectively, are provided below:

AP-MCS-A:
(SEQ ID NO: 31)
GGCTGTTTTGGCGGATGAGAGAAGATTTTCAGCCTGATACAGATTAAAT

CAGAACGCAGAAGCGGTCTGATAAAACAGAATTTGCCTGGCGGCAGTAG

CGCGGTGGTCCCACCTGACCCCATGCCGAACTCAGAAGTGAAACGCCGT

AGCGCCGATGGTAGTGTGGGGTCTCCCCATGCGAGAGTAGGGAACTGCC

AGGCATCAAATAAAACGAAAGGCTCAGTCGAAAGACTGGGCCTTTCGTT

TTATCTGTTGTTTGTCGGTGAACGCTCTCCTGAGTAGGACAAATCCGCC

GGGAGCGGATTTGAACGTTGCGAAGCAACGGCCCGGAGGGTGGCGGGCA

GGACGCCCGCCATAAACTGCCAGGCATCAAATTAAGCAGAAGGCCATCC

TGACGGATGGCCTTTTTGCGTTTCTACAAACTCTACTCTGCTAGCAAGT

AAGGCCGACAAGCTTGCATGCCTGCAGGTCGACTCTAGAGGATCCCCGG

GTACCGAGCTCGAATTCCCTTTTTTTTGGAGATTTTCAACGTGAAAAA

ATTATTATTCGCAATTCCTTTAGTTGTTCCTTTCTATTCTCACTCCGCT

GAAACTGTTGAAAGTTGTTTAGCAAAACCCCATACAGAAAATTCATTTA

-continued

CTAACGTCTGGAAAGACGACAAAACTTTAGATCGTTACGCTAACTATGA

GGGCTGTCTGTGGAATGCTACAGGCGTTGTAGTTTGTACTGGTGACGAA

ACTCAGTGTTACGGTACATGGGTTCCTATTGGGCTTGCTATCCCTGAAA

ATGAGGGTGGTGGCTCTGAGGGTGGCGGTTCTGAGGGTGGCGGTTCTGA

GGGTGGCGGTACTAAACCTCCTGAGTACGGTGATACACCTATTCCGGGC

TATACTTATATCAACCCTCTCGACGGCACTTATCCGCCTGGTACTGAGC

AAAACCCCGCTAATCCTAATCCTTCTCTTGAGGAGTCTCAGCCTCTTAA

TACTTTCATGTTTCAGAATAATAGGTTCCGAAATAGGCAGGGGGCATTA

ACTGTTTATACGGGCACTGTTACTCAAGGCACTGACCCCGTTAAAACTT

ATTACCAGTACACTCCTGTATCATCAAAAGCCATGTATGACGCTTACTG

GAACGGTAAATTCAGAGACTGCGCTTTCCATTCTGGCTTTAATGAGGAT

CCATTCGTTTGTGAATATCAAGGCCAATCGTCTGACCTGCCTCAACCTC

CTGTCAATGCTGGCGGCGGCTCTGGTGGTGGTTCTGGTGGCGGCTCTGA

GGGTGGTGGCTCTGAGGGTGGCGGTTCTGAGGGTGGCGGCTCTGAGGGA

GGCGGTTCCGGTGGTGGCTCTGGTTCCGGTGATTTTGATTATGAAAAGA

TGGCAAACGCTAATAAGGGGGCTATGACCGAAAATGCCGATGAAAACGC

GCTACAGTCTGACGCTAAAGGCAAACTTGATTCTGTCGCTACTGATTAC

GGTGCTGCTATCGATGGTTTCATTGGTGACGTTTCCGGCCTTGCTAATG

GTAATGGTGCTACTGGTGATTTTGCTGGCTCTAATTCCCAAATGGCTCA

AGTCGGTGACGGTGATAATTCACCTTTAATGAATAATTTCCGTCAATAT

TTACCTTCCCTCCCTCAATCGGTTGAATGTCGCCCTTTTGTCTTTGGCG

CTGGTAAACCATATGAATTTTCTATTGATTGTGACAAAATAAACTTATT

CCGTGGTGTCTTTGCGTTTCTTTTATATGTTGCCACCTTTATGTATGTA

TTTTCTACGTTTGCTAACATACTGCGTAATAAGGAGTCTTAATCATGCC

AGTTCTAGCATAACCCCTTGGGGCCTCTAAACGGGTCTTGAGGGGTTTT

TTGCCTTGTCGGCCTTACTTGCTAAATACATTCAAATATGTATCCGCTC

ATGAGACAATAACCCTGATAAATGCTTCAATAATATTGAAAAAGGAAGA

GTATGAGTATTCAACATTTCCGTGTCGCCCTTATTCCCTTTTTTGCGGC

ATTTTGCCTTCCTGTTTTTGCTCACCCAGAAACGCTGGTGAAAGTAAAA

GATGCTGAAGATCAGTTGGGTGCACGAGTGGGTTACATCGAACTGGATC

TCAACAGCGGTAAGATCCTTGAGAGTTTTCGCCCCGAAGAACGTTTTCC

AATGATGAGCACTTTTAAAGTTCTGCTATGTGGCGCGGTATTATCCCGT

ATTGACGCCGGGCAAGAGCAACTCGGTCGCCGCATACACTATTCTCAGA

ATGACTTGGTTGAGTACTCACCAGTCACAGAAAAGCATCTTACGGATGG

CATGACAGTAAGAGAATTATGCAGTGCTGCCATAACCATGAGTGATAAC

ACTGCGGCCAACTTACTTCTGACAACGATCGGAGGACCGAAGGAGCTAA

CCGCTTTTTTGCACAACATGGGGGATCATGTAACTCGCCTTGATCGTTG

GGAACCGGAGCTGAATGAAGCCATACCAAACGACGAGCGTGACACCACG

ATGCCTGTAGCAATGGCAACAACGTTGCGCAAACTATTAACTGGCGAAC

TACTTACTCTAGCTTCCCGGCAACAATTGATAGACTGGATGGAGGCGGA

-continued

TAAAGTTGCAGGACCACTTCTGCGCTCGGCCCTTCCGGCTGGCTGGTTT

ATTGCTGATAAATCTGGAGCCGGTGAGCGTGGCTCTCGCGGTATCATTG

CAGCACTGGGGCCAGATGGTAAGCCCTCCCGTATCGTAGTTATCTACAC

GACGGGGAGTCAGGCAACTATGGATGAACGAAATAGACAGATCGCTGAG

ATAGGTGCCTCACTGATTAAGCATTGGTAAGAACCTCAGATCCTTCCGT

GATGGTAACTCACTAGTTTAAAAGGATCTAGGTGAAGATCCTTTTTGAT

AATCTCATGACCAAAATCCCTTAACGTGAGTTTTCGTTCCACTGAGCGT

CAGAGAACCTCAGATCCTTCCGTATTTAGCCAGTATGTTCTCTAGTGTG

GTTCGTTGTTTTTGCGTGAGCCATGAGAACGAACCATTGAGATCATGCT

TACTTTGCATGTCACTCAAAAATTTTGCCTCAAAACTGGTGAGCTGAAT

TTTTGCAGTTAAAGCATCGTGTAGTGTTTTTCTTAGTCCGTTACGTAGG

TAGGAATCTGATGTAATGGTTGTTGGTATTTTGTCACCATTCATTTTTA

TCTGGTTGTTCTCAAGTTCGGTTACGAGATCCATTTGTCTATCTAGTTC

AACTTGGAAAATCAACGTATCAGTCGGGCGGCCTCGCTTATCAACCACC

AATTTCATATTGCTGTAAGTGTTTAAATCTTTACTTATTGGTTTCAAAA

CCCATTGGTTAAGCCTTTTAAAACTCATGGTAGTTATTTTCAAGCATTAA

CATGAACTTAAATTCATCAAGGCTAATCTCTATATTTGCCTTGTGAGTT

TTCTTTTGTGTTAGTTCTTTTAATAACCACTCATAAATCCTCATAGAGT

ATTTGTTTTCAAAAGACTTAACATGTTCCAGATTATATTTTATGAATTT

TTTTACTGGAAAAGATAAGGCAATATCTCTTCACTAAAAACTAATTCTA

ATTTTTCGCTTGAGAACTTGGCATAGTTTGTCCACTGGAAAATCTCAAA

GCCTTTAACCAAAGGATTCCTGATTTCCACAGTTCTCGTCATCAGCTCT

CTGGTTGCTTTAGCTAATACACCATAAGCATTTTCCCTACTGATGTTCA

TCATCTGAGCGTATTGGTTATAAGTGAACGATACCGTCCGTTCTTTCCT

TGTAGGGTTTTCAATCGTGGGGTTGAGTAGTGCCACACAGCATAAAATT

AGCTTGGTTTCATGCTCCGTTAAGTCATAGCGACTAATCGCTAGTTCAT

TTGCTTTGAAAACAACTAATTCAGACATACATCTCAATTGGTCTAGGTG

ATTTTAATCACTATACCAATTGAGATGGGCTAGTCAATGATAATTACTA

GTCCTTTTCCTTTGAGTTGTGGGTATCTGTAAATTCTGCTAGACCTTTG

CTGGAAAACTTGTAAATTCTGCTAGACCCTCTGTAAATTCCGCTAGACC

TTTGTGTGTTTTTTTGTTTATATTCAAGTGGTTATAATTTATAGAATA

AAGAAAGAATAAAAAAAGATAAAAAGAATAGATCCCAGCCCTGTGTATA

ACTCACTACTTTAGTCAGTTCCGCAGTATTACAAAAGGATGTCGCAAAC

GCTGTTTGCTCCTCTACAAAACAGACCTTAAAACCCTAAAGGCTTAAGT

AGCACCCTCGCAAGCTCGGGCAAATCGCTGAATATTCCTTTTGTCTCCG

ACCATCAGGCACCTGAGTCGCTGTCTTTTTCGTGACATTCAGTTCGCTG

CGCTCACGGCTCTGGCAGTGAATGGGGTAAATGGCACTACAGGCGCCT

TTTATGGATTCATGCAAGGAAACTACCCATAATACAAGAAAAGCCCGTC

ACGGGCTTCTCAGGGCGTTTTATGGCGGGTCTGCTATGTGGTGCTATCT

-continued

GACTTTTTGCTGTTCAGCAGTTCCTGCCCTCTGATTTTCCAGTCTGACC

ACTTCGGATTATCCCGTGACAGGTCATTCAGACTGGCTAATGCACCCAG

TAAGGCAGCGGTATCATCAACT

AP-MCS-P:

(SEQ ID NO: 32)

GGCTGTTTTGGCGGATGAGAGAAGATTTTCAGCCTGATACAGATTAAAT

CAGAACGCAGAAGCGGTCTGATAAAACAGAATTTGCCTGGCGGCAGTAG

CGCGGTGGTCCCACCTGACCCCATGCCGAACTCAGAAGTGAAACGCCGT

AGCGCCGATGGTAGTGTGGGGTCTCCCCATGCGAGAGTAGGGAACTGCC

AGGCATCAAATAAAACGAAAGGCTCAGTCGAAAGACTGGGCCTTTCGTT

TTATCTGTTGTTTGTCGGTGAACGCTCTCCTGAGTAGGACAAATCCGCC

GGGAGCGGATTTGAACGTTGCGAAGCAACGGCCCGGAGGGTGGCGGGCA

GGACGCCCGCCATAAACTGCCAGGCATCAAATTAAGCAGAAGGCCATCC

TGACGGATGGCCTTTTTGCGTTTCTACAAACTCTACTCTGCTAGCAAGT

AAGGCCGACAAGCTTGCATGCCTGCAGGTCGACTCTAGAGGATCCCCGG

GTACCGAGCTCGAATTCCCTTTTTTTTGGAGATTTTCAACGTGAAAAA

ATTATTATTCGCAATTCCTTTAGTTGTTCCTTTCTATTCTCACTCCGCT

GAAACTGTTGAAAGTTGTTTAGCAAAACCCCATACAGAAAATTCATTTA

CTAACGTCTGGAAAGACGACAAAACTTTAGATCGTTACGCTAACTATGA

GGGCTGTCTGTGGAATGCTACAGGCGTTGTAGTTTGTACTGGTGACGAA

ACTCAGTGTTACGGTACATGGGTTCCTATTGGCTTGCTATCCCTGAAA

ATGAGGGTGGTGGCTCTGAGGGTGGCGGTTCTGAGGGTGGCGGTTCTGA

GGGTGGCGGTACTAAACCTCCTGAGTACGGTGATACACCTATTCCGGGC

TATACTTATATCAACCCTCTCGACGGCACTTATCCGCCTGGTACTGAGC

AAAACCCCGCTAATCCTAATCCTTCTCTTGAGGAGTCTCAGCCTCTTAA

TACTTTCATGTTTCAGAATAATAGGTTCCGAAATAGGCAGGGGGCATTA

ACTGTTTATACGGGCACTGTTACTCAAGGCACTGACCCCGTTAAAACTT

ATTACCAGTACACTCCTGTATCATCAAAAGCCATGTATGACGCTTACTG

GAACGGTAAATTCAGAGACTGCGCTTTCCATTCTGGCTTTAATGAGGAT

CCATTCGTTTGTGAATATCAAGGCCAATCGTCTGACCTGCCTCAACCTC

CTGTCAATGCTGGCGGCGGCTCTGGTGGTGGTTCTGGTGGCGGCTCTGA

GGGTGGTGGCTCTGAGGGTGGCGGTTCTGAGGGTGGCGGCTCTGAGGGA

GGCGGTTCCGGTGGTGGCTCTGGTTCCGGTGATTTTGATTTGAAAAGAT

GGCAAACGCTAATAAGGGGGCTATGACCGAAAATGCCGATGAAAACGCG

CTACAGTCTGACGCTAAAGGCAAACTTGATTCTGTCGCTACTGATTACG

GTGCTGCTATCGATGGTTTCATTGGTGACGTTTCCGGCCTTGCTAATGG

TAATGGTGCTACTGGTGATTTTGCTGGCTCTAATTCCCAAATGGCTCAA

GTCGGTGACGGTGATAATTCACCTTTAATGAATAATTTCCGTCAATATT

TACCTTCCCTCCCTCAATCGGTTGAATGTCGCCCTTTTGTCTTTGGCGC

TGGTAAACCATATGAATTTTCTATTGATTGTGACAAAATAAACTTATTC

CGTGGTGTCTTTGCGTTTCTTTTATATGTTGCCACCTTTATGTATGTAT

TTTCTACGTTTGCTAACATACTGCGTAATAAGGAGTCTTAATCATGCCA

```
GTTCTAGCATAACCCCTTGGGGCCTCTAAACGGGTCTTGAGGGGTTTTT
TGCCTTGTCGGCCTTACTTGCTAAATACATTCAAATATGTATCCGCTCA
TGAGACAATAACCCTGATAAATGCTTCAATAATATTGAAAAAGGAAGAG
TATGAGTATTCAACATTTCCGTGTCGCCCTTATTCCCTTTTTTGCGGCA
TTTTGCCTTCCTGTTTTTGCTCACCCAGAAACGCTGGTGAAAGTAAAAG
ATGCTGAAGATCAGTTGGGTGCACGAGTGGGTTACATCGAACTGGATCT
CAACAGCGGTAAGATCCTTGAGAGTTTTCGCCCCGAAGAACGTTTTCCA
ATGATGAGCACTTTTAAAGTTCTGCTATGTGGCGCGGTATTATCCCGTA
TTGACGCCGGGCAAGAGCAACTCGGTCGCCGCATACACTATTCTCAGAA
TGACTTGGTTGAGTACTCACCAGTCACAGAAAAGCATCTTACGGATGGC
ATGACAGTAAGAGAATTATGCAGTGCTGCCATAACCATGAGTGATAACA
CTGCGGCCAACTTACTTCTGACAACGATCGGAGGACCGAAGGAGCTAAC
CGCTTTTTTGCACAACATGGGGGATCATGTAACTCGCCTTGATCGTTGG
GAACCGGAGCTGAATGAAGCCATACCAAACGACGAGCGTGACACCACGA
TGCCTGTAGCAATGGCAACAACGTTGCGCAAACTATTAACTGGCGAACT
ACTTACTCTAGCTTCCCGGCAACAATTGATAGACTGGATGGAGGCGGAT
AAAGTTGCAGGACCACTTCTGCGCTCGGCCCTTCCGGCTGGCTGGTTTA
TTGCTGATAAATCTGGAGCCGGTGAGCGTGGCTCTCGCGGTATCATTGC
AGCACTGGGGCCAGATGGTAAGCCCTCCCGTATCGTAGTTATCTACACG
ACGGGGAGTCAGGCAACTATGGATGAACGAAATAGACAGATCGCTGAGA
TAGGTGCCTCACTGATTAAGCATTGGTAAGAACCTCAGATCCTTCCGTG
ATGGTAACTCACTAGTTTAAAAGGATCTAGGTGAAGATCCTTTTTGATA
ATCTCATGACCAAAATCCCTTAACGTGAGTTTTCGTTCCACTGAGCGTC
AGAGAACCTCAGATCCTTCCGTATTTAGCCAGTATGTTCTCTAGTGTGG
TTCGTTGTTTTTGCGTGAGCCATGAGAACGAACCATTGAGATCATGCTT
ACTTTGCATGTCACTCAAAAATTTTGCCTCAAAACTGGTGAGCTGAATT
TTTGCAGTTAAAGCATCGTGTAGTGTTTTTCTTAGTCCGTTACGTAGGT
AGGAATCTGATGTAATGGTTGTTGGTATTTTGTCACCATTCATTTTTAT
CTGGTTGTTCTCAAGTTCGGTTACGAGATCCATTTGTCTATCTAGTTCA
ACTTGGAAAATCAACGTATCAGTCGGGCGGCCTCGCTTATCAACCACCA
ATTTCATATTGCTGTAAGTGTTTAAATCTTTACTTATTGGTTTCAAAAC
CCATTGGTTAAGCCTTTTAAACTCATGGTAGTTATTTTCAAGCATTAAC
ATGAACTTAAATTCATCAAGGCTAATCTCTATATTTGCCTTGTGAGTTT
TCTTTTGTGTTAGTTCTTTTAATAACCACTCATAAATCCTCATAGAGTA
TTTGTTTTCAAAAGACTTAACATGTTCCAGATTATATTTTATGAATTTT
TTTAACTGGAAAAGATAAGGCAATATCTCTTCACTAAAAACTAATTCTA
ATTTTTCGCTTGAGAACTTGGCATAGTTTGTCCACTGGAAAATCTCAAA
GCCTTTAACCAAAGGATTCCTGATTTCCACAGTTCTCGTCATCAGCTCT
CTGGTTGCTTTAGCTAATACACCATAAGCATTTTCCCTACTGATGTTCA
TCATCTGAGCGTATTGGTTATAAGTGAACGATACCGTCCGTTCTTTCCT
TGTAGGGTTTTCAATCGTGGGGTTGAGTAGTGCCACACAGCATAAAATT
AGCTTGGTTTCATGCTCCGTTAAGTCATAGCGACTAATCGCTAGTTCAT
TTGCTTTGAAAACAACTAATTCAGACATACATCTCAATTGGTCTAGGTG
ATTTTAATCACTATACCAATTGAGATGGGCTAGTCAATGATAATTACTA
GTCCTTTTCCTTTGAGTTGTGGGTATCTGTAAATTCTGCTAGACCTTTG
CTGGAAAACTTGTAAATTCTGCTAGACCCTCTGTAAATTCCGCTAGACC
TTTGTGTGTTTTTTTTGTTTATATTCAAGTGGTTATAATTTATAGAATA
AAGAAAGAATAAAAAAAGATAAAAAGAATAGATCCCAGCCCTGTGTATA
ACTCACTACTTTAGTCAGTTCCGCAGTATTACAAAAGGATGTCGCAAAC
GCTGTTTGCTCCTCTACAAAACAGACCTTAAAACCCTAAAGGCTTAAGT
AGCACCCTCGCAAGCTCGGGCAAATCGCTGAATATTCCTTTTGTCTCCG
ACCATCAGGCACCTGAGTCGCTGTCTTTTTCGTGACATTCAGTTCGCTG
CGCTCACGGCTCTGGCAGTGAATGGGGGTAAATGGCACTACAGGCGCCT
TTTATGGATTCATGCAAGGAAACTACCCATAATACAAGAAAAGCCCGTC
ACGGGCTTCTCAGGGCGTTTTATGGCGGGTCTGCTATGTGGTGCTATCT
GACTTTTTGCTGTTCAGCAGTTCCTGCCCTCTGATTTTCCAGTCTGACC
ACTTCGGATTATCCCGTGACAGGTCATTCAGACTGGCTAATGCACCCAG
TAAGGCAGCGGTATCATCAACT
```

In some embodiments, the gene to be evolved encodes a transcription factor that can directly drive expression from a conditional promoter, resulting in a relatively straightforward linkage of activity of the gene to be evolved to phage packaging efficiency. In embodiments where the gene of interest encodes a gene product that cannot directly drive transcription from a promoter, the linkage of activity of the gene to be evolved to viral particle packaging is provided indirectly, for example, as described in International PCT Application, PCT/US2009/056194, filed Sep. 8, 2009, published as WO 2010/028347 on Mar. 11, 2010; International PCT Application, PCT/US2011/066747, filed Dec. 22, 2011, published as WO 2012/088381 on Jun. 28, 2012; U.S. Application, U.S. Ser. No. 13/922,812, filed Jun. 20, 2013; and U.S. Application, U.S. Ser. No. 62/067,194, filed Oct. 22, 2014, the entire contents of each of which are incorporated herein by reference.

In some embodiments, the host cells comprise all phage genes except for the at least one gene for the generation of infectious phage particles in the form of a helper phage. In some embodiments, the phage genes on the helper phage include pI, pII, pIV, pV, pVI, pVII, pVIII, pIX, and/or pX. Some exemplary helper phages suitable for use in such embodiments are provided herein, and additional suitable helper phages will be apparent to the skilled artisan based on the instant disclosure. The host cell may also provide phage functions based on expression constructs other than helper phage, for example, expression constructs integrated into the host cell genome or provided on artificial chromosomes or on separate plasmids. One advantage of providing phage functions in the host cell, e.g., by using a helper phage, is that the selection phage encoding the gene of interest can be deficient in genes encoding proteins or other functions provided by the host cell and can, accordingly, carry a longer gene of interest.

In some embodiments, diversifying the vector population is achieved by providing a flow of host cells that does not select for gain-of-function mutations in the gene of interest for replication, mutagenesis, and propagation of the population of vectors. In some embodiments, the host cells are host cells that express all genes required for the generation of infectious viral particles, for example, bacterial cells that express a complete helper phage, and, thus, do not impose selective pressure on the gene of interest. In other embodiments, the host cells comprise an accessory plasmid comprising a conditional promoter with a baseline activity sufficient to support viral vector propagation even in the absence of significant gain-of-function mutations of the gene of interest. This can be achieved by using a "leaky" conditional promoter, by using a high-copy number accessory plasmid, thus amplifying baseline leakiness, and/or by using a conditional promoter on which the initial version of the gene of interest effects a low level of activity while a desired gain-of-function mutation effects a significantly higher activity.

Such methods involving host cells of varying selective stringency or varying the selection stringency in other ways as described herein allow for harnessing the power of continuous evolution methods as provided herein for the evolution of functions that are completely absent in the initial version of the gene of interest, for example, for the evolution of enzymes that bind substrates not recognized by the initial enzyme used at the outset of the respective PACE experiments at all.

In some embodiments, the PACE methods provided herein further comprises a negative selection for undesired activity of the gene to be evolved in addition to the positive selection for a desired activity of the gene to be evolved. Such negative selection methods are useful, for example, in order to maintain enzyme specificity when increasing the efficiency of an enzyme directed towards a specific substrate. This can avoid, for example, the evolution of gene products that show a generally increased activity of the gene to be evolved, including an increased off-target activity, which is often undesired.

In some embodiments, negative selection is applied during a continuous evolution process as described herein, by penalizing the undesired activities of evolved gene products. This is useful, for example, if the desired evolved gene product is an enzyme with high specificity for a substrate or target site, for example, a transcription factor with altered, but not broadened, specificity. In some embodiments, negative selection of an undesired activity, e.g., off-target activity of the gene to be evolved, is achieved by causing the undesired activity to interfere with pIII production, thus inhibiting the propagation of phage genomes encoding gene products with an undesired activity. In some embodiments, expression of a dominant-negative version of pIII or expression of an antisense RNA complementary to the gIII RBS and/or gIII start codon is linked to the presence of an undesired activity of the gene to be evolved. Suitable negative selection strategies and reagents useful for negative selection, such as dominant-negative versions of M13 pIII, are described herein and in International PCT Application, PCT/US2009/056194, filed Sep. 8, 2009, published as WO 2010/028347 on Mar. 11, 2010; International PCT Application, PCT/US2011/066747, filed Dec. 22, 2011, published as WO 2012/088381 on Jun. 28, 2012; U.S. Application, U.S. Ser. No. 13/922,812, filed Jun. 20, 2013; and U.S. Application, U.S. Ser. No. 62/067,194, filed Oct. 22, 2014, the entire contents of each of which are incorporated herein by reference.

In some embodiments, counter-selection against undesired activity is achieved by linking such undesired activities to the inhibition of phage propagation. In some embodiments, a dual selection strategy is applied during a continuous evolution experiment, in which both positive selection and negative selection constructs are present in the host cells. In some such embodiments, the positive and negative selection constructs are situated on the same plasmid, also referred to as a dual selection accessory plasmid.

One advantage of using a simultaneous dual selection strategy is that the selection stringency can be fine-tuned based on the activity or expression level of the negative selection construct as compared to the positive selection construct. Another advantage of a dual selection strategy is that the selection is not dependent on the presence or the absence of a desired or an undesired activity, but on the ratio of desired and undesired activities, and, thus, the resulting ratio of pIII and pIII-neg that is incorporated into the respective phage particle.

For example, in some embodiments, the host cells comprise an expression construct encoding a dominant-negative form of the at least one gene for the generation of infectious phage particles, e.g., a dominant-negative form of the pIII protein (pIII-neg), under the control of an inducible promoter that is activated by a transcriptional activator other than the transcriptional activator driving the positive selection system. Expression of the dominant-negative form of the gene diminishes or completely negates any selective advantage an evolved phage may exhibit and thus dilutes or eradicates any variants exhibiting undesired activity from the lagoon.

Some aspects of this invention provide or utilize a dominant negative variant of pIII (pIII-neg). These aspects are based on the recognition that a pIII variant that comprises the two N-terminal domains of pIII and a truncated, termination-incompetent C-terminal domain is not only inactive but is a dominant-negative variant of pIII. A pIII variant comprising the two N-terminal domains of pIII and a truncated, termination-incompetent C-terminal domain was described in Bennett, N. J.; Rakonjac, J., Unlocking of the filamentous bacteriophage virion during infection is mediated by the C domain of pIII. *Journal of Molecular Biology* 2006, 356 (2), 266-73; the entire contents of which are incorporated herein by reference. The dominant negative property of such pIII variants has been described in more detail in PCT Application PCT/US2011/066747, published as WO2012/088381 on Jun. 28, 2012, the entire contents of which are incorporated herein by reference.

The pIII-neg variant as provided in some embodiments herein is efficiently incorporated into phage particles, but it does not catalyze the unlocking of the particle for entry during infection, rendering the respective phage noninfectious even if wild type pIII is present in the same phage particle. Accordingly, such pIII-neg variants are useful for devising a negative selection strategy in the context of PACE, for example, by providing an expression construct comprising a nucleic acid sequence encoding a pIII-neg variant under the control of a promoter comprising a recognition motif, the recognition of which is undesired. In other embodiments, pIII-neg is used in a positive selection strategy, for example, by providing an expression construct in which a pIII-neg encoding sequence is controlled by a promoter comprising a nuclease target site or a repressor recognition site, the recognition of either one is desired.

In some embodiments, the vector or phage encoding the gene to be evolved is a filamentous phage, for example, an M13 phage, such as an M13 selection phage as described in more detail elsewhere herein. In some embodiments, the host cells are cells amenable to infection by the filamentous phage, e.g., by M13 phage, such as, for example, *E. coli* cells. In some such embodiments, the gene required for the production of infectious viral particles is the M13 gene III (gIII) encoding the M13 protein III (pIII).

Typically, the vector/host cell combination is chosen in which the life cycle of the vector is significantly shorter than the average time between cell divisions of the host cell. Average cell division times and vector life cycle times are well known in the art for many cell types and vectors, allowing those of skill in the art to ascertain such host cell/vector combinations. In certain embodiments, host cells are being removed from the population of host cells in which the vector replicates at a rate that results in the average time of a host cell remaining in the host cell population before being removed to be shorter than the average time between cell divisions of the host cells, but to be longer than the average life cycle of the viral vector employed. The result of this is that the host cells, on average, do not have sufficient time to proliferate during their time in the host cell population while the viral vectors do have sufficient time to infect a host cell, replicate in the host cell, and generate new viral particles during the time a host cell remains in the cell population. This assures that the only replicating nucleic acid in the host cell population is the vector encoding the gene to be evolved, and that the host cell genome, the accessory plasmid, or any other nucleic acid constructs cannot acquire mutations allowing for escape from the selective pressure imposed.

For example, in some embodiments, the average time a host cell remains in the host cell population is about 10, about 11, about 12, about 13, about 14, about 15, about 16, about 17, about 18, about 19, about 20, about 21, about 22, about 23, about 24, about 25, about 30, about 35, about 40, about 45, about 50, about 55, about 60, about 70, about 80, about 90, about 100, about 120, about 150, or about 180 minutes.

In some embodiments, the average time a host cell remains in the host cell population depends on how fast the host cells divide and how long infection (or conjugation) requires. In general, the flow rate should be faster than the average time required for cell division, but slow enough to allow viral (or conjugative) propagation. The former will vary, for example, with the media type, and can be delayed by adding cell division inhibitor antibiotics (FtsZ inhibitors in *E. coli*, etc.). Since the limiting step in continuous evolution is production of the protein required for gene transfer from cell to cell, the flow rate at which the vector washes out will depend on the current activity of the gene(s) of interest. In some embodiments, titrable production of the protein required for the generation of infectious particles, as described herein, can mitigate this problem. In some embodiments, an indicator of phage infection allows computer-controlled optimization of the flow rate for the current activity level in real-time.

In some embodiments, a PACE experiment according to methods provided herein is run for a time sufficient for at least 10, at least 20, at least 30, at least 40, at least 50, at least 100, at least 200, at least 300, at least 400, at least, 500, at least 600, at least 700, at least 800, at least 900, at least 1000, at least 1250, at least 1500, at least 1750, at least 2000, at least 2500, at least 3000, at least 4000, at least 5000, at least 7500, at least 10000, or more consecutive viral life cycles. In certain embodiments, the viral vector is an M13 phage, and the length of a single viral life cycle is about 10-20 minutes.

In some embodiments, the host cells are contacted with the vector and/or incubated in suspension culture. For example, in some embodiments, bacterial cells are incubated in suspension culture in liquid culture media. Suitable culture media for bacterial suspension culture will be apparent to those of skill in the art, and the invention is not limited in this regard. See, for example, *Molecular Cloning: A Laboratory Manual,* 2nd Ed., ed. by Sambrook, Fritsch, and Maniatis (Cold Spring Harbor Laboratory Press: 1989); Elizabeth Kutter and Alexander Sulakvelidze: *Bacteriophages: Biology and Applications*. CRC Press; $1^{st}$ edition (December 2004), ISBN: 0849313368; Martha R. J. Clokie and Andrew M. Kropinski: *Bacteriophages: Methods and Protocols, Volume* 1*: Isolation, Characterization, and Interactions* (*Methods in Molecular Biology*) Humana Press; $1^{st}$ edition (December, 2008), ISBN: 1588296822; Martha R. J. Clokie and Andrew M. Kropinski: *Bacteriophages: Methods and Protocols, Volume* 2: *Molecular and Applied Aspects* (*Methods in Molecular Biology*) Humana Press; $1^{st}$ edition (December 2008), ISBN: 1603275649; all of which are incorporated herein in their entirety by reference for disclosure of suitable culture media for bacterial host cell culture).

Suspension culture typically requires the culture media to be agitated, either continuously or intermittently. This is achieved, in some embodiments, by agitating or stirring the vessel comprising the host cell population. In some embodiments, the outflow of host cells and the inflow of fresh host cells is sufficient to maintain the host cells in suspension. This in particular, if the flow rate of cells into and/or out of the lagoon is high.

In some embodiments, the flow of cells through the lagoon is regulated to result in an essentially constant number of host cells within the lagoon. In some embodiments, the flow of cells through the lagoon is regulated to result in an essentially constant number of fresh host cells within the lagoon. Typically, the lagoon will hold host cells in liquid media, for example, cells in suspension in a culture media. However, lagoons in which adherent host cells are cultured on a solid support, such as on beads, membranes, or appropriate cell culture surfaces are also envisioned. The lagoon may comprise additional features, such as a stirrer or agitator for stirring or agitating the culture media, a cell densitometer for measuring cell density in the lagoon, one or more pumps for pumping fresh host cells into the culture vessel and/or for removing host cells from the culture vessel, a thermometer and/or thermocontroller for adjusting the culture temperature, as well as sensors for measuring pH, osmolarity, oxygenation, and other parameters of the culture media. The lagoon may also comprise an inflow connected to a holding vessel comprising a mutagen or a transcriptional inducer of a conditional gene expression system, such as the arabinose-inducible expression system of the mutagenesis plasmid described in more detail elsewhere herein.

In some embodiments, the host cell population is continuously replenished with fresh, uninfected host cells. In some embodiments, this is accomplished by a steady stream of fresh host cells into the population of host cells. In other embodiments, however, the inflow of fresh host cells into the lagoon is semi-continuous or intermittent (e.g., batch-fed). In some embodiments, the rate of fresh host cell inflow into the cell population is such that the rate of removal of cells from the host cell population is compensated. In some embodiments, the result of this cell flow compensation is that the number of cells in the cell population is substantially constant over the time of the continuous evolution procedure. In some embodiments, the portion of fresh, uninfected cells in the cell population is substantially constant over the time of the continuous evolution procedure. For example, in some embodiments, about 10%, about 15%, about 20%, about 25%, about 30%, about 40%, about 50%, about 60%, about 70%, about 75%, about 80%, or about 90% of the cells in the host cell population are not infected by virus. In general, the faster the flow rate of host cells is, the smaller the portion of cells in the host cell population that are infected will be. However, faster flow rates allow for more transfer cycles, e.g., viral life cycles, and, thus, for more generations of evolved vectors in a given period of time, while slower flow rates result in a larger portion of infected host cells in the host cell population and therefore a larger library size at the cost of slower evolution. In some embodiments, the range of effective flow rates is invariably bounded by the cell division time on the slow end and vector washout on the high end In some embodiments, the viral load, for example, as measured in infectious viral particles per volume of cell culture media is substantially constant over the time of the continuous evolution procedure.

Typically, the fresh host cells introduced into the lagoon comprise a mutagenesis expression construct as provided herein, a selection system, e.g., an accessory plasmid encoding the at least one gene for the generation of infectious phage particles, and an expression construct providing other phage functions, such as, for example, a helper phage. In some embodiments, however, the host cells may not comprise an expression construct providing other phage functions, such as, for example, a helper phage, and those functions are provided to the host cells in some other way, e.g., as part of the selection phage. In some embodiments, the host cells are generated by contacting an uninfected host cell with the relevant vectors, for example, a vector comprising a mutagenesis expression construct as provided herein, an accessory plasmid, and, if desired, a helper phage, and growing an amount of host cells sufficient for the replenishment of the host cell population in a continuous evolution experiment. Methods for the introduction of plasmids and other gene constructs into host cells are well known to those of skill in the art and the invention is not limited in this respect. For bacterial host cells, such methods include, but are not limited to electroporation and heat-shock of competent cells. In some embodiments, the accessory plasmid comprises a selection marker, for example, an antibiotic resistance marker, and the fresh host cells are grown in the presence of the respective antibiotic to ensure the presence of the plasmid in the host cells. Where multiple plasmids are present, different markers are typically used. Such selection markers and their use in cell culture are known to those of skill in the art, and the invention is not limited in this respect.

In some embodiments, the host cell population in a continuous evolution experiment is replenished with fresh host cells growing in a parallel, continuous culture. In some embodiments, the cell density of the host cells in the host cell population contacted with the viral vector and the density of the fresh host cell population is substantially the same.

Typically, the cells being removed from the cell population contacted with the vector comprise cells that are infected with the vector and uninfected cells. In some embodiments, cells are being removed from the cell populations continuously, for example, by effecting a continuous outflow of the cells from the population. In other embodiments, cells are removed semi-continuously or intermittently from the population. In some embodiments, the replenishment of fresh cells will match the mode of removal of cells from the cell population, for example, if cells are continuously removed, fresh cells will be continuously introduced. However, in some embodiments, the modes of replenishment and removal may be mismatched, for example, a cell population may be continuously replenished with fresh cells, and cells may be removed semi-continuously or in batches.

In some embodiments, the rate of fresh host cell replenishment and/or the rate of host cell removal is adjusted based on quantifying the host cells in the cell population. For example, in some embodiments, the turbidity of culture media comprising the host cell population is monitored and, if the turbidity falls below a threshold level, the ratio of host cell inflow to host cell outflow is adjusted to effect an increase in the number of host cells in the population, as manifested by increased cell culture turbidity. In other embodiments, if the turbidity rises above a threshold level, the ratio of host cell inflow to host cell outflow is adjusted to effect a decrease in the number of host cells in the population, as manifested by decreased cell culture turbidity. Maintaining the density of host cells in the host cell population within a specific density range ensures that enough host cells are available as hosts for the evolving viral vector population, and avoids the depletion of nutrients at the cost of viral packaging and the accumulation of cell-originated toxins from overcrowding the culture.

In some embodiments, the cell density in the host cell population and/or the fresh host cell density in the inflow is about $10^2$ cells/ml to about $10^{12}$ cells/ml. In some embodiments, the host cell density is about $10^2$ cells/ml, about $10^3$ cells/ml, about $10^4$ cells/ml, about $10^5$ cells/ml, about $5 \cdot 10^5$ cells/ml, about $10^6$ cells/ml, about $5 \cdot 10^6$ cells/ml, about $10^7$ cells/ml, about $5 \cdot 10^7$ cells/ml, about $10^8$ cells/ml, about $5 \cdot 10^8$ cells/ml, about $10^9$ cells/ml, about $5 \cdot 10^9$ cells/ml, about $10^{10}$ cells/ml, or about $5 \cdot 10^{10}$ cells/ml. In some embodiments, the host cell density is more than about $10^{10}$ cells/ml.

The PACE methods provided herein are typically carried out in a lagoon. Suitable lagoons and other laboratory equipment for carrying out PACE methods as provided herein have been described in detail elsewhere. See, for example, International PCT Application, PCT/US2011/066747, published as WO2012/088381 on Jun. 28, 2012, the entire contents of which are incorporated herein by reference. In some embodiments, the lagoon comprises a cell culture vessel comprising an actively replicating population of vectors, for example, phage vectors comprising a gene of interest, and a population of host cells, for example, bacterial host cells. In some embodiments, the lagoon comprises an inflow for the introduction of fresh host cells into the lagoon and an outflow for the removal of host cells from the lagoon. In some embodiments, the inflow is connected to a turbidostat comprising a culture of fresh host cells. In some embodiments, the outflow is connected to a waste vessel, or a sink. In some embodiments, the lagoon further comprises an inflow for the introduction of a mutagen into the lagoon. In some embodiments that inflow is connected to a vessel holding a solution of the mutagen. In some embodiments, the lagoon comprises an inflow for the introduction of an inducer of gene expression into the lagoon, for example, of an inducer activating an inducible promoter within the host cells that drives expression of a gene promoting mutagenesis (e.g., as part of a mutagenesis plasmid), as described in more detail elsewhere herein. In some embodiments, that inflow is connected to a vessel comprising a solution of the inducer, for example, a solution of arabinose.

In some embodiments, the lagoon comprises a controller for regulation of the inflow and outflow rates of the host cells, the inflow of the mutagen, and/or the inflow of the inducer. In some embodiments, a visual indicator of phage presence, for example, a fluorescent marker, is tracked and used to govern the flow rate, keeping the total infected population constant. In some embodiments, the visual marker is a fluorescent protein encoded by the phage genome, or an enzyme encoded by the phage genome that, once expressed in the host cells, results in a visually detectable change in the host cells. In some embodiments, the visual tracking of infected cells is used to adjust a flow rate to keep the system flowing as fast as possible without risk of vector washout.

In some embodiments, the controller regulates the rate of inflow of fresh host cells into the lagoon to be substantially the same (volume/volume) as the rate of outflow from the lagoon. In some embodiments, the rate of inflow of fresh host cells into and/or the rate of outflow of host cells from the lagoon is regulated to be substantially constant over the time of a continuous evolution experiment. In some embodiments, the rate of inflow and/or the rate of outflow is from about 0.1 lagoon volumes per hour to about 25 lagoon volumes per hour. In some embodiments, the rate of inflow and/or the rate of outflow is approximately 0.1 lagoon volumes per hour (lv/h), approximately 0.2 lv/h, approximately 0.25 lv/h, approximately 0.3 lv/h, approximately 0.4 lv/h, approximately 0.5 lv/h, approximately 0.6 lv/h, approximately 0.7 lv/h, approximately 0.75 lv/h, approximately 0.8 lv/h, approximately 0.9 lv/h, approximately 1 lv/h, approximately 2 lv/h, approximately 2.5 lv/h, approximately 3 lv/h, approximately 4 lv/h, approximately 5 lv/h, approximately 7.5 lv/h, approximately 10 lv/h, or more than 10 lv/h.

In some embodiments, the inflow and outflow rates are controlled based on a quantitative assessment of the population of host cells in the lagoon, for example, by measuring the cell number, cell density, wet biomass weight per volume, turbidity, or cell growth rate. In some embodiments, the lagoon inflow and/or outflow rate is controlled to maintain a host cell density of from about $10^2$ cells/ml to about $10^{12}$ cells/ml in the lagoon. In some embodiments, the inflow and/or outflow rate is controlled to maintain a host cell density of about $10^2$ cells/ml, about $10^3$ cells/ml, about $10^4$ cells/ml, about $10^5$ cells/ml, about $5\times10^5$ cells/ml, about $10^6$ cells/ml, about $5\times10^6$ cells/ml, about $10^7$ cells/ml, about $5\times10^7$ cells/ml, about $10^8$ cells/ml, about $5\times10^8$ cells/ml, about $10^9$ cells/ml, about $5\times10^9$ cells/ml, about $10^{10}$ cells/ml, about $5\times10^{10}$ cells/ml, or more than $5\times10^{10}$ cells/ml, in the lagoon. In some embodiments, the density of fresh host cells in the turbidostat and the density of host cells in the lagoon are substantially identical.

In some embodiments, the lagoon inflow and outflow rates are controlled to maintain a substantially constant number of host cells in the lagoon. In some embodiments, the inflow and outflow rates are controlled to maintain a substantially constant frequency of fresh host cells in the lagoon. In some embodiments, the population of host cells is continuously replenished with fresh host cells that are not infected by the phage. In some embodiments, the replenishment is semi-continuous or by batch-feeding fresh cells into the cell population.

In some embodiments, the lagoon volume is from approximately 1 ml to approximately 100l, for example, the lagoon volume is approximately 1 ml, approximately 10 ml, approximately 50 ml, approximately 100 ml, approximately 200 ml, approximately 250 ml, approximately 500 ml, approximately 750 ml, approximately 1l, approximately 2l, approximately 2.5l, approximately 3l, approximately 4l, approximately 5l, approximately 10l, approximately 20l, approximately 50l, approximately 100l, approximately 200l, approximately 500l, approximately 750l, approximately 100l, approximately 1 ml-10 ml, approximately 10 ml-50 ml, approximately 50 ml-100 ml, approximately 100 ml-250 ml, approximately 250 ml-500 ml, approximately 500 ml-1l, approximately 1l-2l, approximately 2l-5l, approximately 5l-10l, approximately 10l-50l, approximately 50l-100l, or more than 100l.

In some embodiments, the lagoon and/or the turbidostat further comprises a heater and a thermostat controlling the temperature. In some embodiments, the temperature in the lagoon and/or the turbidostat is controlled to be from about 4° C. to about 55° C., preferably from about 25° C. to about 39° C., for example, about 37° C.

In some embodiments, the inflow rate and/or the outflow rate is controlled to allow for the incubation and replenishment of the population of host cells for a time sufficient for at least 10, at least 20, at least 30, at least 40, at least 50, at least 100, at least 200, at least 300, at least 400, at least, 500, at least 600, at least 700, at least 800, at least 900, at least 1000, at least 1250, at least 1500, at least 1750, at least 2000, at least 2500, at least 3000, at least 4000, at least 5000, at least 7500, at least 10000, or more consecutive vector or phage life cycles. In some embodiments, the time sufficient for one phage life cycle is about 10, 15, 20, 25, or 30 minutes.

Therefore, in some embodiments, the time of the entire evolution procedure is about 12 hours, about 18 hours, about 24 hours, about 36 hours, about 48 hours, about 50 hours, about 3 days, about 4 days, about 5 days, about 6 days, about 7 days, about 10 days, about two weeks, about 3 weeks, about 4 weeks, or about 5 weeks.

In some embodiments, a PACE method as provided herein is performed in a suitable apparatus as described herein. For example, in some embodiments, the apparatus comprises a lagoon that is connected to a turbidostat comprising a host cell as described herein. In some embodiments, the host cell is an *E. coli* host cell. In some embodiments, the host cell comprises a mutagenesis expression construct as provided herein, an accessory plasmid as described herein, and, optionally, a helper plasmid as described herein, or any combination thereof. In some embodiments, the lagoon further comprises a selection phage as described herein, for example, a selection phage encoding a gene of interest. In some embodiments, the lagoon is connected to a vessel comprising an inducer for a mutagenesis plasmid, for example, arabinose. In some embodiments, the host cells are *E. coli* cells comprising the F' plasmid, for example, cells of the genotype F'proA$^+$B$^+$ Δ(lacIZY) zzf::Tn10(TetR)/endA1 recA1 galE15 galK16 nupG rpsL ΔlacIZYA araD139 Δ(ara, leu)7697 mcrA Δ(mrr-hsdRMS-mcrBC) proBA::pir116λ$^-$.

For example, in some embodiments, a PACE method as provided herein is carried out in an apparatus comprising a lagoon of about 100 ml, or about 1l volume, wherein the lagoon is connected to a turbidostat of about 0.5l, 1l, or 3l volume, and to a vessel comprising an inducer for a mutagenesis plasmid, for example, arabinose, wherein the lagoon and the turbidostat comprise a suspension culture of *E. coli* cells at a concentration of about $5\times10^8$ cells/ml. In some embodiments, the flow of cells through the lagoon is regulated to about 3 lagoon volumes per hour. In some embodiments, cells are removed from the lagoon by continuous pumping, for example, by using a waste needle set at a height of the lagoon vessel that corresponds to a desired volume of fluid (e.g., about 100 ml, in the lagoon. In some embodiments, the host cells are *E. coli* cells comprising the F' plasmid, for example, cells of the genotype F'proA$^+$B$^+$ Δ(lacIZY) zzf::Tn10(TetR)/endA1 recA1 galE15 galK16 nupG rpsL ΔlacIZYA araD139 Δ(ara,leu)7697 mcrA Δ(mrr-hsdRMS-mcrBC) proBA::pir116λ⁻.

In some embodiments, a mutagenesis plasmid (MP) comprises araC, dnaQ926, umuD', umuC, and recA730, and is referred to as "MP1". In some embodiments, a mutagenesis plasmid (MP) comprises araC and dnaQ926, and is referred to as "MP2". In some embodiments, a mutagenesis plasmid (MP) comprises araC, dnaQ926, and dam, and is referred to as "MP3". In some embodiments, a mutagenesis plasmid (MP) comprises araC, dnaQ926, dam, and seqA, and is referred to as "MP4". In some embodiments, a mutagenesis plasmid (MP) comprises araC, dnaQ926, dam, seqA, ugi and pmCDA1, and is referred to as "MP5". In some embodiments, a mutagenesis plasmid (MP) comprises araC, dnaQ926, dam, seqA, emrR, ugi and pmCDA1, and is referred to as "MP6". In some embodiments, a mutagenesis plasmid comprises a sequence represented by any one of SEQ ID NO: 43-123. In some embodiments, a mutagenesis plasmid consists of a sequence represented by any one of SEQ ID NO: 43-123.

Modulation of Selection Stringency

Provided herein is a method for modulating the selection stringency in viral-assisted continuous evolution experiments. In some embodiments, the selection stringency is modulated by regulating the expression of a gene required for the generation of infectious viral particles (e.g., infectious phages). Generally, the gene required for the generation of infectious viral particles is on an accessory plasmid (AP) or on a drift plasmid (DP).

A drift plasmid allows evolutionary drift to take place to evolve weakly active or inactive gene variants. The expression of a gene required for the generation of infectious viral particles produces a protein required for the generation of infectious viral particles. In some embodiments, the gene required for the generation of infectious viral particles is gene III, which expresses the protein pIII needed to generate infections phage. In some embodiments, the modulation of the selection stringency is independent of the desired activity to be evolved. In some embodiments, regulation of the expression of the gene required for the generation of infectious viral particles is under the control of a small molecule inducible promoter (i.e., chemically-regulated promoters) and therefore, is dependent on the concentration of a small molecule. Examples of small molecule inducible promoters are known in the scientific literature (see, e.g., Yamamoto et. al., 2001, Neurobiology of Disease, 8: 923-932). Non-limiting examples of small molecule inducible promoters include lux promoters (e.g. $P_{lux}$ from vibrio fishceri induced by N-(3-oxohexanoyl)-L-homoserine lactone (OHHL)); alcohol-regulated promoters (e.g., alcohol dehydrogenase I promoter (alcA), lac promoter (e.g., $P_{lac}$), arabinose-inducible promoters (e.g., $P_{ara}$), tetracycline-inducible promoters (e.g., $P_{tet}$), steroid-inducible promoters, and tamoxifen-inducible promoters. In some embodiments, the small molecule inducible promoter is a TetA promoter ($P_{tet}$). In some embodiments, the small molecule is tetracycline or tetracycline analogs. In some embodiments, the small molecule is anhydrotetracycline (ATc). In some embodiments, the small molecule is doxycycline. In some embodiments, the host cell drift promoter is partly a tetracycline-inducible promoter ($P_{tet}$), which drives expression of the TetR repressor and TetA, the protein that pumps tetracycline out of the cell. In the absence of tetracycline or its analogs, TetR binds to the TetR operator sites and prevents transcription. In the presence of tetracycline or its analogs, TetR binds to tetracycline or a tetracycline analog, which induces a conformational change, making it unable to interact with the operator, so that target gene expression can occur.

In some embodiments, the host cell becomes viral infection-resistant prior to encountering the viral particle, thereby preventing viral propagation. For example, low levels of pIII, such as the levels expressed at the beginning of a PACE experiment, have been shown to render cells resistant to filamentous phage infection.[10] Accordingly, for situations where low levels of the protein (e.g., pIII) required for the generation of infectious viral particles renders host cells resistant to viral infection, it may be desirable to make the expression of the protein (e.g., pIII) required for the generation of infectious viral particles to be dependent on the condition that there be a prior viral infection of the host cells. In some embodiments, an E. coli phage shock promoter ($P_{psp}$) is used to require prior viral infection. Transcription from $P_{psp}$ is induced by infection with filamentous phage via a pIV-dependent signaling cascade[11] or by overexpression of a plasmid-encoded phage pIV gene.

To produce a system in which protein expression requires both the presence of the small molecule and prior viral infection, provided herein is a drift promoter. In some embodiments, the drift promoter is located on a drift plasmid in the host cell. In some embodiments, the drift promoter is produced from a $P_{psp}$ variant with a TetR operator installed at a position to disrupt either PspF or E. coli RNA polymerase binding. In some embodiments, the TetR operator is placed adjacent to the +1 transcription initiation site to produce a host cell drift promoter called $P_{psp-tet}$, which is induced only with the combination of phage infection and ATc. In some embodiments, the $P_{psp-tet}$ is placed upstream of the gene encoding the pIII protein. In some embodiments, propagation of the viral vector (e.g., SP) proceeds without activity-dependent gene III expression. In some embodiments, SPs can propagate in a small-molecule-dependent, activity-independent manner using the host cell drft promoter. In some embodiments, the drift promoter is produced from one that is activated upon pspF release after phage infection. In some embodiments, the host cell drift promoter is produced from another promoter such as ones upstream of pal or hyfR.

In some embodiments, a drift plasmid (DP) comprises an expression construct in which a drift promoter drives expression of a gene required for the generation of infectious viral particles (e.g., gIII), and an expression construct comprising a sequence encoding one or more gene product(s) that increase(s) the mutation rate in a host cell, e.g., in a bacterial host cell. The one or more gene product(s) that increase(s) the mutation rate in a host cell is, in some embodiments, araC, dnaQ926, umuD', umuC, recA730, dam, seqA, emrR, PBS2, UGI, or pmCDA1, or any combination thereof. In some embodiments, a drift plasmid (DP) comprises an expression construct in which a drift promoter drives expression of a gene required for the generation of infectious viral particles (e.g., gIII), wherein the expression construct is on the same plasmid as a mutagenesis expression construct provided herein, e.g., a mutagenesis expression construct provided in the context of the mutagenesis plasmids provided herein.

Figure 20:
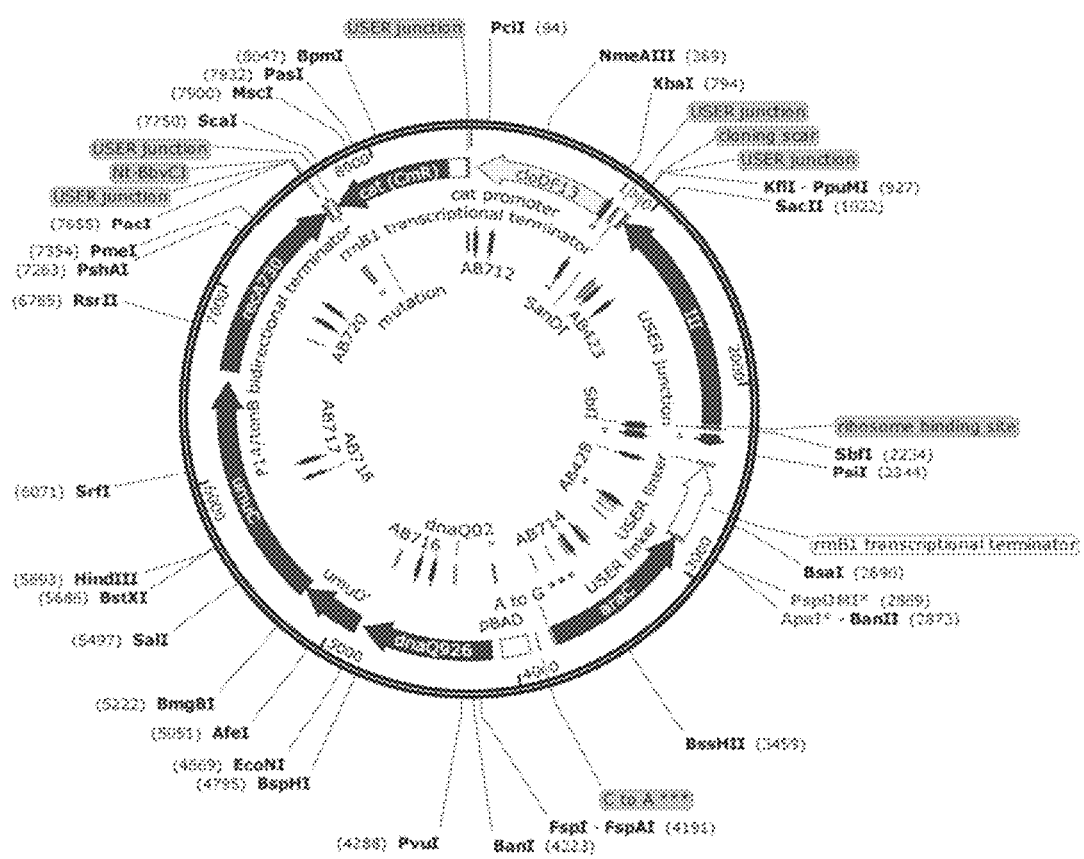
FIG. 20. DP1 Vector Map. A schematic depiction of one embodiment of a DP1 drift plasmid is provided, referenced herein as SEQ ID NO: 27. This embodiment comprises araC, dnaQ926, umuD', umuC, recA730, and an anhydrotetracycline (ATc)-dependent drift promoter.

In some embodiments, a drift plasmid (DP) comprises araC, dnaQ926, umuD', umuC, recA730, and an anhydrotetracycline (ATc)-dependent drift promoter, and is referred to as "DP1". In some embodiments, the ATc-dependent promoter drives expression of a gene required for the generation of infectious viral particles (e.g., gIII). One embodiment of a DP1 plasmid is shown in FIG. 20, and is represented by SEQ ID NO: 27.

Figure 21:
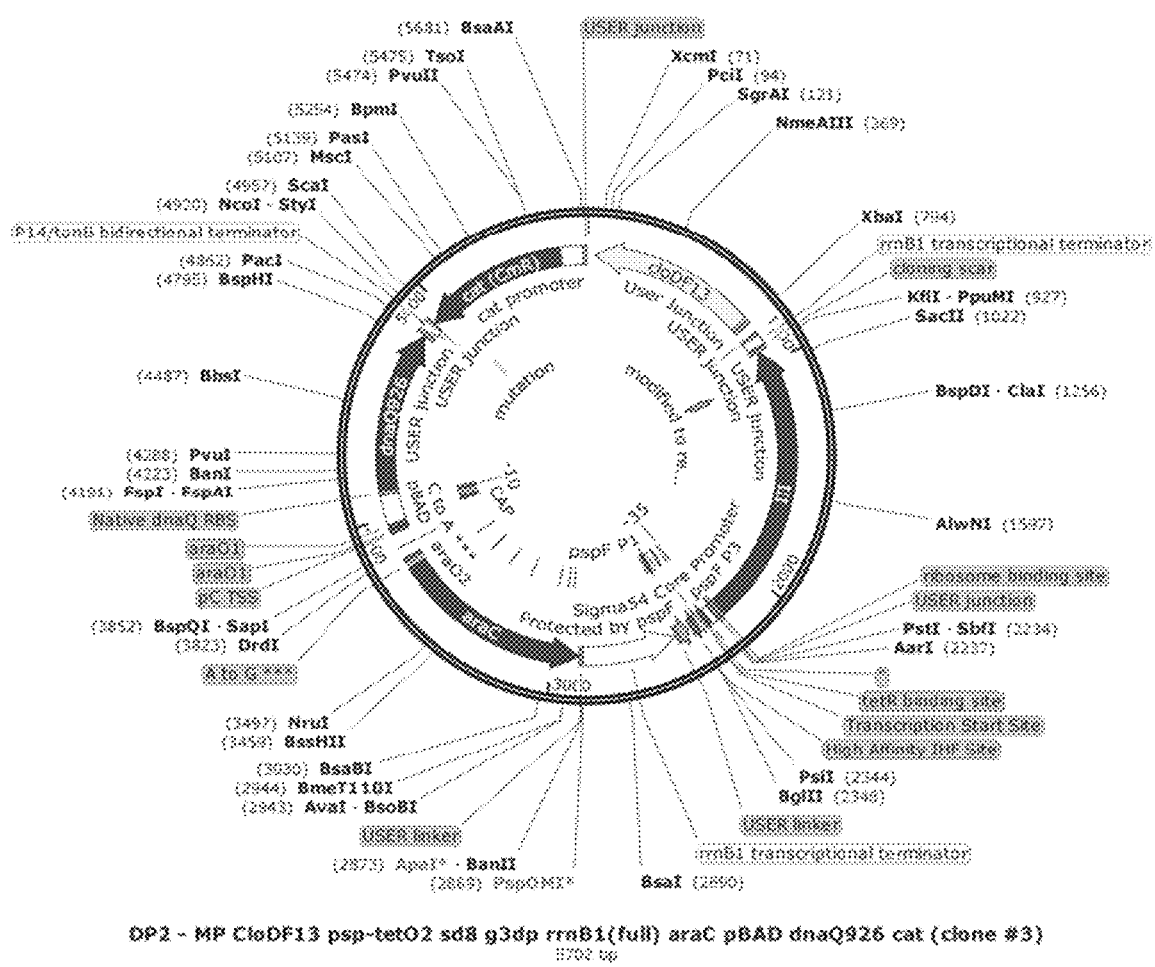
FIG. 21. DP2 Vector Map. A schematic depiction of one embodiment of a DP2 drift vector is provided, referenced herein as SEQ ID NO: 28. This embodiment comprises araC, dnaQ926, and an anhydrotetracycline (ATc)-dependent drift promoter.

In some embodiments, a drift plasmid (DP) comprises araC, dnaQ926, and an anhydrotetracycline (ATc)-dependent drift promoter, and is referred to as "DP2". In some embodiments, the ATc-dependent promoter drives expression of a gene required for the generation of infectious viral particles (e.g., gIII). One embodiment of a DP2 plasmid is shown in FIG. 21, and is represented by SEQ ID NO: 28.

Figure 22:
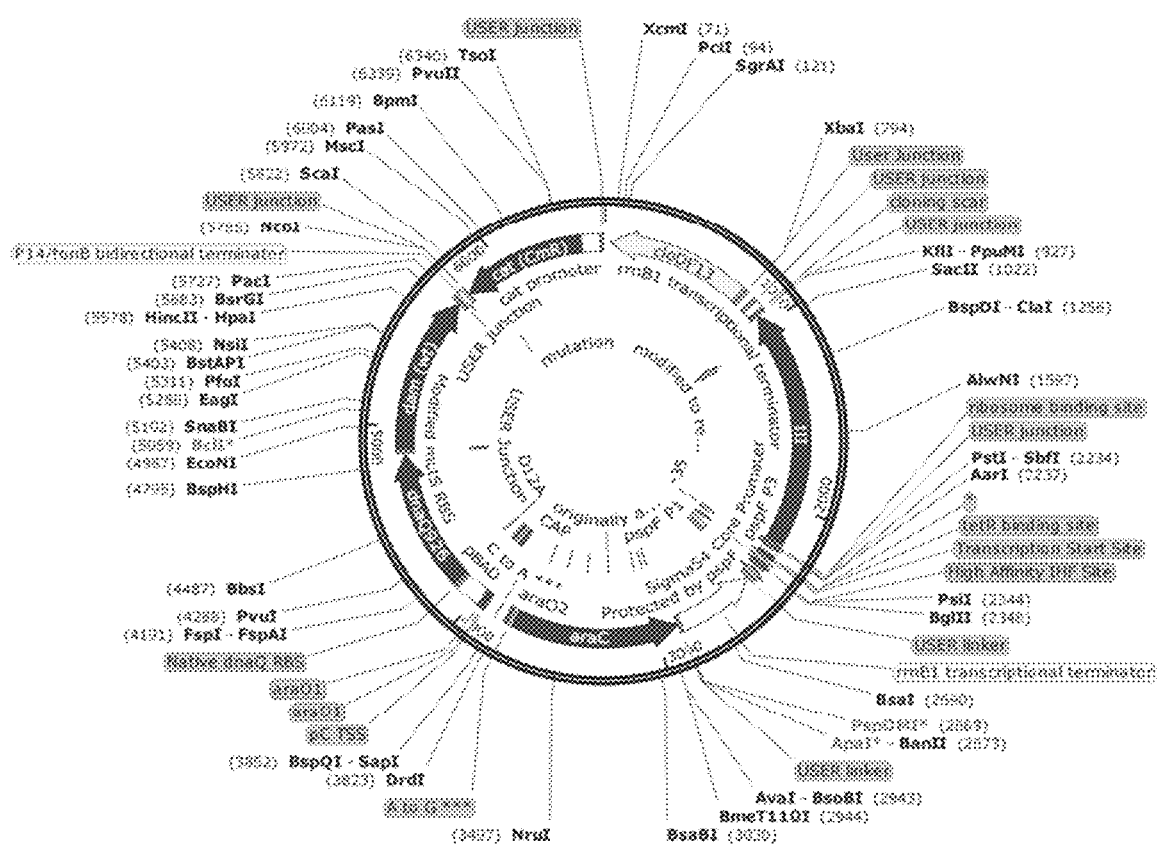
FIG. 22. DP3 Vector Map. A schematic depiction of one embodiment of a DP3 drift vector is provided, referenced herein as SEQ ID NO: 29. This embodiment comprises araC, dnaQ926, dam, and an anhydrotetracycline (ATc)-dependent drift promoter.

In some embodiments, a drift plasmid (DP) comprises araC, dnaQ926, dam, and an anhydrotetracycline (ATc)-dependent drift promoter, and is referred to as "DP3". In some embodiments, the ATc-dependent promoter drives expression of a gene required for the generation of infectious viral particles (e.g., gIII). One embodiment of a DP3 plasmid is shown in FIG. 22, and is represented by SEQ ID NO: 29.

Figure 23:
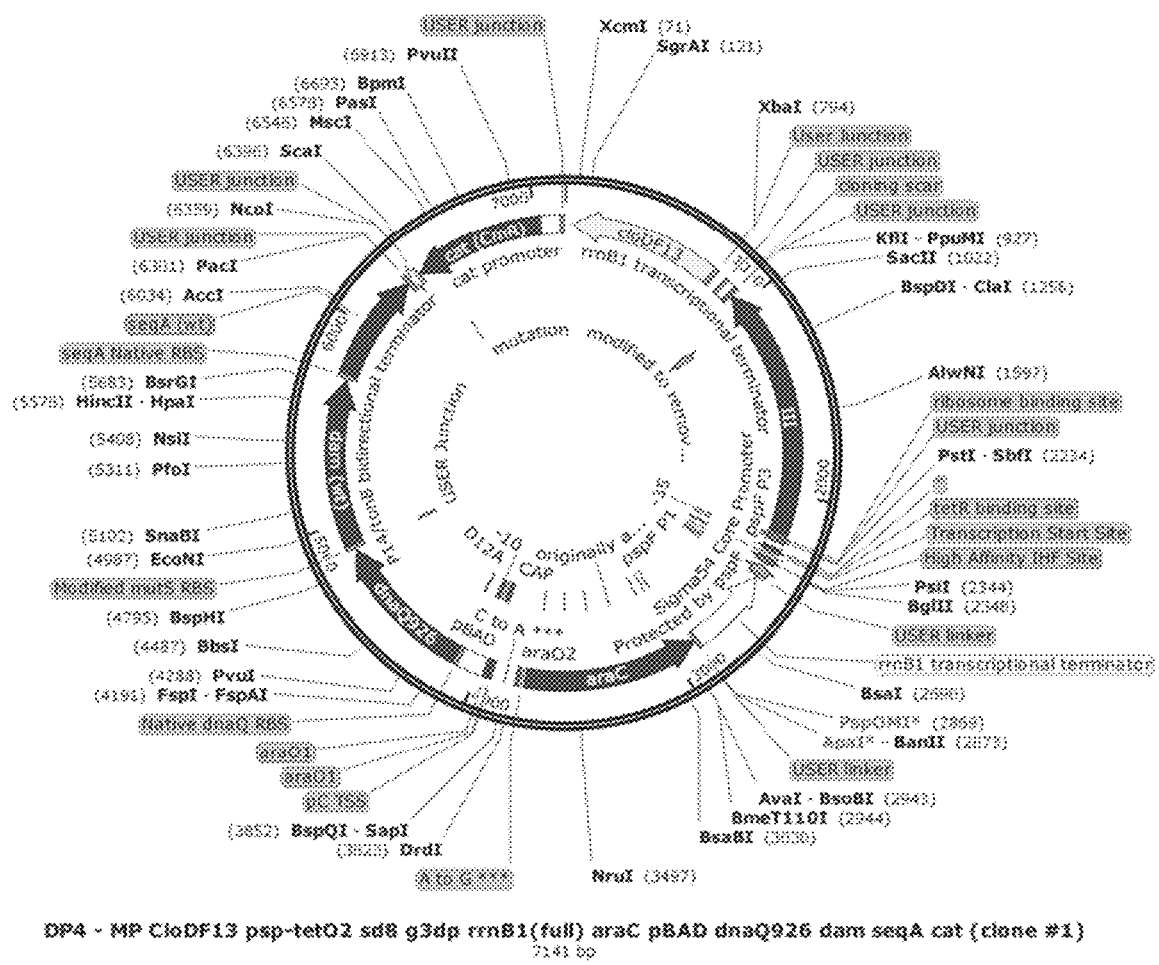
FIG. 23. DP4 Vector Map. A schematic depiction of one embodiment of a DP4 drift vector is provided, referenced herein as SEQ ID NO: 33. This embodiment comprises araC, dnaQ926, dam, seqA, and an anhydrotetracycline (ATc)-dependent drift promoter.

In some embodiments, a drift plasmid (DP) comprises araC, dnaQ926, dam, seqA, and an anhydrotetracycline (ATc)-dependent drift promoter, and is referred to as "DP4". In some embodiments, the ATc-dependent promoter drives expression of a gene required for the generation of infectious viral particles (e.g., gIII). One embodiment of a DP4 plasmid is shown in FIG. 23, and is represented by SEQ ID NO: 33.

Figure 24:
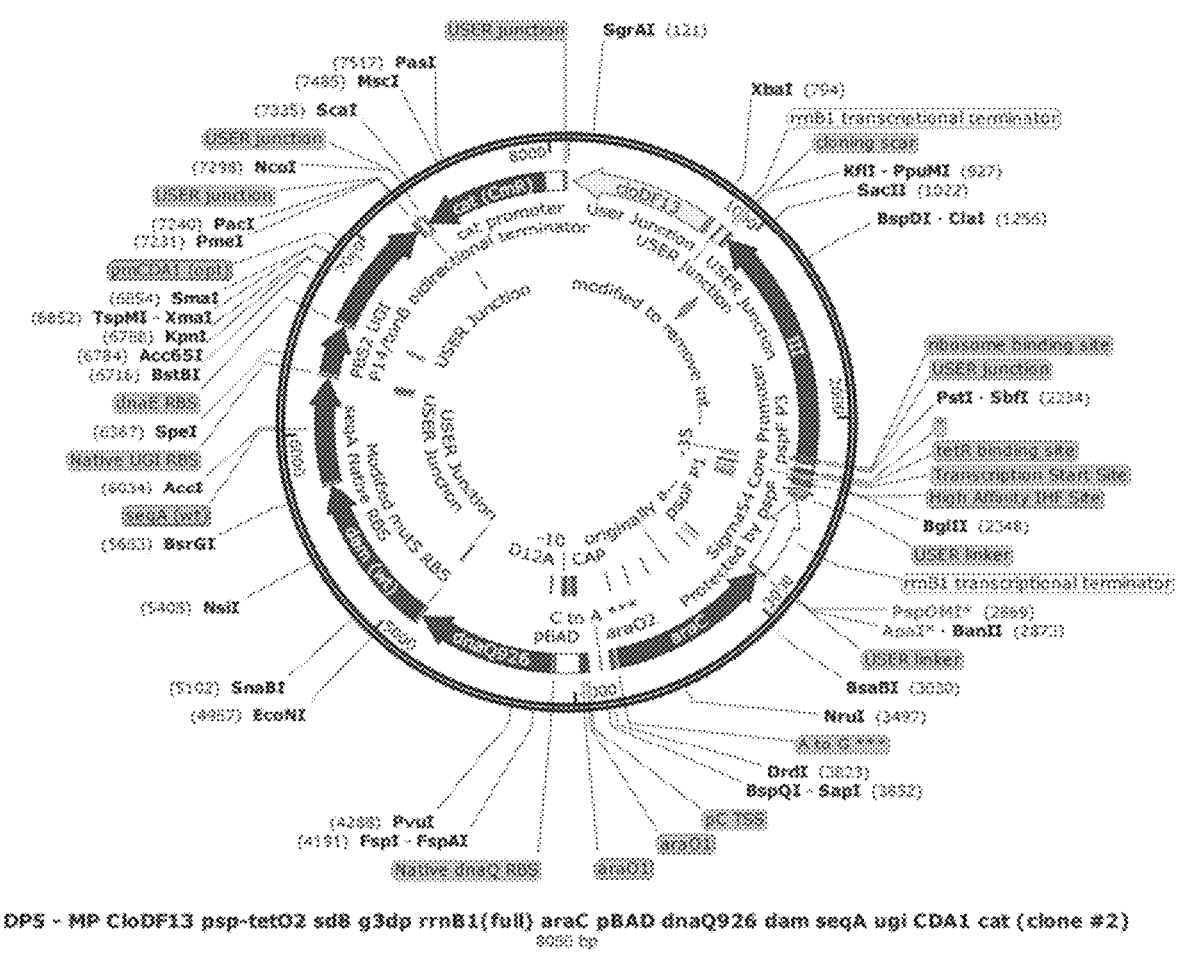
FIG. 24. DP5 Vector Map. A schematic depiction of one embodiment of a DP5 drift vector is provided, referenced herein as SEQ ID NO: 34. This embodiment comprises araC, dnaQ926, dam, seqA, ugi and/or pmCDA1, and an anhydrotetracycline (ATc)-dependent drift promoter.

In some embodiments, a drift plasmid (DP) comprises araC, dnaQ926, dam, seqA, ugi and pmCDA1, and an anhydrotetracycline (ATc)-dependent drift promoter, and is referred to as "DP5". In some embodiments, the ATc-dependent promoter drives expression of a gene required for the generation of infectious viral particles (e.g., gIII). One embodiment of a DP5 plasmid is shown in FIG. 24, and is represented by SEQ ID NO: 34.

Figure 25:
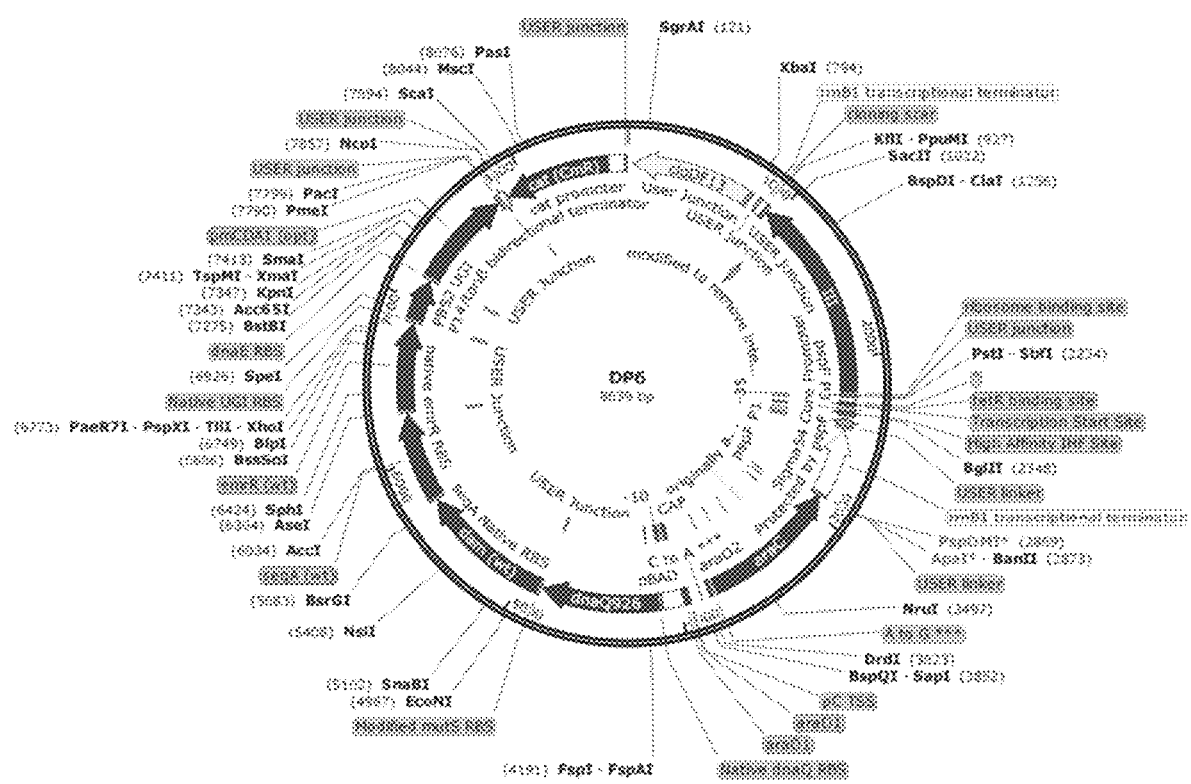
FIG. 25. DP6 Vector Map. A schematic depiction of one embodiment of a DP6 drift vector is provided, referenced herein as SEQ ID NO: 35. This embodiment comprises araC, dnaQ926, dam, seqA, emrR, ugi and/or pmCDA1, and an anhydrotetracycline (ATc)-dependent drift promoter.

In some embodiments, a drift plasmid (DP) comprises araC, dnaQ926, dam, seqA, emrR, ugi and pmCDA1, and an anhydrotetracycline (ATc)-dependent drift promoter, and is referred to as "DP6". In some embodiments, the ATc-dependent promoter drives expression of a gene required for the generation of infectious viral particles (e.g., gIII). One embodiment of a DP6 plasmid is shown in FIG. 25, and is represented by SEQ ID NO: 35.

In some embodiments, provided is a method of tuning the selection stringency in continuous directed evolution methods. For example, to tune the selection stringency, a host cell can use the following plasmids: an activity-dependent AP, such as a P7-gene III AP, in which gene III is controlled by an activity-dependent promoter; and a drift plasmid (DP) with a host cell drift promoter-gene III cassette, such as a $P_{psp\text{-}tet}$-gene III. In some embodiments, the AP additionally contains a reporter gene such as a luciferase gene. In some embodiments, the selection stringency is inversely proportional to the concentration of the small molecule used. In some embodiments, low selection stringency conditions are used. For example, saturating amounts of a small molecule inducer (e.g., ATc) allows the $P_{psp\text{-}tet}$-gene III cassette in the DP to provide sufficient pIII to maximize phage propagation, regardless of the SP-encoded property (such as activity), thus enabling genetic drift of the SP (low stringency). In some embodiments, an intermediate selection stringency is used. For example, at intermediate concentrations of a small molecule inducer (e.g., ATc), SPs encoding active library members have a replicative advantage over an SP encoding a weakly active/inactive variant by inducing additional pIII expression from an activity-dependent manner. An intermediate concentration is determined by sampling a number of concentrations of the small molecule by using a plasmid that carries the native $P_{tet}$ promoter driving bacterial luciferase. Intermediate concentrations are typically considered those around the inflection point of a sigmoidal graph. In some embodiments, high selection stringency conditions are used. For example, a zero or low amount of a small molecule inducer (e.g., ATc) allows the selection stringency to be determined by the activity-dependent AP with no assistance from the $P_{psp\text{-}tet}$-gene III cassette (high stringency).

In some embodiments, the evolution experiments uses a ratio of SPs with active starting genetic libraries to SPs with weakly active/inactive starting genetic libraries of about 1:1, 1:5, 1:10, 1:20, 1:40, 1:60, 1:80, 1:100, 1:120, 1:60, or 1:200. In some embodiments, the ratio of SPs with active to weakly active/inactive starting libraries is 1:100. In some embodiments, phage population is generally followed over time using a detectable label or directly via standard techniques. For example, the phage population can be followed using a combination of restriction endonuclease digests and/or real-time measurements of luminescence monitoring of promoter transcriptional activity (e.g., $P_{T7}$ transcriptional activity), as further described herein. Additional methods are PCR, plaque assays, analysis by gel electrophoresis, or analytical digestion. In some embodiments, an accessory plasmid carrying the gene III and a gene encoding a co-expressed reporter fluorescent protein (such as the luciferase gene, GFP, or other fluorescent protein described herein) under the control of a conditional promoter (such as a $P_{T7}$ or $P_{T3}$) would produce luminescence from the translated luciferase when there is promoter transcriptional activity.

Selection stringency modulation can be used at any point in the continuous evolution process. In some embodiments, selection stringency modulation is used towards the end of the continuous evolution process. In some embodiments, selection stringency modulation is used towards the beginning of the continuous evolution process. In some embodiments, the selection stringency modulation is combined with negative selection.

In an embodiment, provided is a method for modulating the selection stringency during viral-assisted evolution of a gene product, the method comprising: (a) introducing host cells into a lagoon, wherein the host cell comprises a low selection stringency plasmid and a high selection stringency plasmid, wherein the low selection stringency plasmid comprises a viral gene required to package the selection viral vector into an infectious viral particles, wherein at least one gene required to package the selection viral vector into an infectious viral particles is expressed in response to the a concentration of a small molecule, and wherein the high selection stringency plasmid comprises a second copy of the viral gene required to package the selection viral vector into the infectious viral particles, wherein at least one viral gene required to package the selection viral vector into an infectious viral particles is expressed in response to a desired activity property of a gene product encoded by the gene to be evolved or an evolution product thereof; (b) introducing a selection viral vector comprising a gene to be evolved into a flow of host cells through a lagoon, wherein the gene to be evolved produces an active gene product or a weakly active or inactive gene product, wherein the active gene product has an activity that drives the expression of the viral gene required to package the selection viral vector into infectious viral particles in the high selection stringency plasmid and wherein the weakly active or inactive gene product has a relatively lower activity than the activity of the active gene product; and (c) mutating the gene to be evolved within the flow of host cells, wherein the host cells are introduced through the lagoon at a flow rate that is faster than the replication rate of the host cells and slower than the replication rate of the virus thereby permitting replication of the selection viral vector in the lagoon. In an embodiment, the host cells are fed from a chemostat into the lagoon.

In some embodiments, the method further comprising isolating the selection viral vector comprising an evolved product from the flow of cells and determining one or more properties of the evolved product. In some embodiments, the low selection stringency plasmid contains a drift promoter that is activated by a concentration of a small molecule inducer and/or prior viral infection. In one embodiment, the high selection stringency plasmid contains a promoter that is activated by a desired property of a gene product encoded by the gene to be evolved or an evolution product thereof. In yet another embodiment, the low selection stringency plasmid comprises a mutagenesis cassette under the control of a small-molecule inducible promoter. In another embodiment, the low selection stringency plasmid allows a high level of evolutionary drift to occur when the drift promoter is activated in response to a concentration of a small molecule inducer and/or prior viral infection. In some embodiments, the high selection stringency plasmid allows a low level of evolutionary drift to occur when the promoter is activated in response to a desired activity property of a gene product encoded by the gene to be evolved or an evolution product thereof.

In some embodiments, the property of the gene to be evolved originated from a weakly active or inactive starting gene. In some embodiments, the property of the gene to be evolved originated from an active starting gene. In an embodiment, the high selection stringency comprises a T7 promoter. In another embodiment, the low selection stringency comprises a drift promoter that is activated by a small-molecule inducer and/or prior viral infection. In some embodiments, the drift promoter is a $P_{psp}$-tet promoter.

In some embodiments, the method of modulating the selection stringency further comprises the use of negative selection and/or positive selection.

Host Cells

Some aspects of this invention relate to host cells for continuous evolution processes as described herein. In some embodiments, a host cell is provided that comprises a mutagenesis expression construct as provided herein. In some embodiments, the host cell further comprises additional plasmids or constructs for carrying out a PACE process, e.g., a selection system comprising at least one viral gene encoding a protein required for the generation of infectious viral particles under the control of a conditional promoter the activity of which depends on a desired function of a gene to be evolved. For example, some embodiments provide host cells for phage-assisted continuous evolution processes, wherein the host cell comprises an accessory plasmid comprising a gene required for the generation of infectious phage particles, for example, M13 gIII, under the control of a conditional promoter, as described herein. In some embodiments, the host cell further provides any phage functions that are not contained in the selection phage, e.g., in the form of a helper phage. In some embodiments, the host cell provided further comprises an expression construct comprising a gene encoding a mutagenesis-inducing protein, for example, a mutagenesis plasmid as provided herein.

In some embodiments, modified viral vectors are used in continuous evolution processes as provided herein. In some embodiments, such modified viral vectors lack a gene required for the generation of infectious viral particles. In some such embodiments, a suitable host cell is a cell comprising the gene required for the generation of infectious viral particles, for example, under the control of a constitutive or a conditional promoter (e.g., in the form of an accessory plasmid, as described herein). In some embodiments, the viral vector used lacks a plurality of viral genes. In some such embodiments, a suitable host cell is a cell that comprises a helper construct providing the viral genes required for the generation of infectious viral particles. A cell is not required to actually support the life cycle of a viral vector used in the methods provided herein. For example, a cell comprising a gene required for the generation of infectious viral particles under the control of a conditional promoter may not support the life cycle of a viral vector that does not comprise a gene of interest able to activate the promoter, but it is still a suitable host cell for such a viral vector.

In some embodiments, the host cell is a prokaryotic cell, for example, a bacterial cell. In some embodiments, the host cell is an *E. coli* cell. In some embodiments, the host cell is a eukaryotic cell, for example, a yeast cell, an insect cell, or a mammalian cell. The type of host cell, will, of course, depend on the viral vector employed, and suitable host cell/viral vector combinations will be readily apparent to those of skill in the art.

In some embodiments, the viral vector is a phage and the host cell is a bacterial cell. In some embodiments, the host cell is an *E. coli* cell. Suitable *E. coli* host strains will be apparent to those of skill in the art, and include, but are not limited to, New England Biolabs (NEB) Turbo, Top10F', DH12S, ER2738, ER2267, and XL1-Blue MRF'. These strain names are art recognized and the genotype of these strains has been well characterized. It should be understood that the above strains are exemplary only and that the invention is not limited in this respect.

In some PACE embodiments, for example, in embodiments employing an M13 selection phage, the host cells are *E. coli* cells expressing the Fertility factor, also commonly referred to as the F factor, sex factor, or F-plasmid. The F-factor is a bacterial DNA sequence that allows a bacterium to produce a sex pilus necessary for conjugation and is essential for the infection of *E. coli* cells with certain phage, for example, with M13 phage. For example, in some embodiments, the host cells for M13-PACE are of the genotype F'proA$^+$B$^+$ Δ(lacIZY) zzf::Tn10(TetR)/endA1 recA1 galE15 galK16 nupG rpsL ΔlacIZYA araD139 Δ(ara, leu)7697 mcrA Δ(mrr-hsdRMS-mcrBC) proBA::pir116λ.

Kits and Apparatuses

Some aspects of this disclosure provide kits comprising (a) an expression construct or plasmid as provided herein, wherein the expression construct comprises an inducible promoter controlling at least one of the nucleic acid sequences comprised in the expression construct; and (b) an inducing agent that induces expression from the inducible promoter. In some embodiments, the kit further comprises (c) a vector encoding an M13 phage backbone and a multiple cloning site for insertion of a nucleic acid sequence encoding a gene product to be evolved, wherein the vector or a replication product thereof can be packaged into infectious phage particles in the presence of other phage functions by suitable host cells, but lacks at least one gene required for the generation of infectious particles. In some embodiments, the kit further comprises (d) an accessory plasmid comprising a nucleic acid sequence encoding the at least one gene required for the generation of infectious particles under the control of a promoter that is activated by a desired activity of the gene product to be evolved. In some embodiments, the kit further comprises (e) an accessory plasmid comprising a nucleic acid sequence encoding a dominant-negative version of the at least one gene required for the generation of infectious particles under the control of a promoter that is activated by an undesired activity of the gene product to be evolved. In some embodiments, the kit further comprises a helper phage providing all phage functions except for the at least one gene required for the generation of infectious phage particles provided by the accessory plasmid of (d). In some embodiments, the helper phage or a replication product thereof cannot be packaged into infectious phage particles. In some embodiments, the kit comprises suitable host cells. In some embodiments, the host cells are E. coli host cells.

Some aspects of this invention provide kits for continuous directed evolution as described herein. In some embodiments, the kit comprises (a) a vector encoding a phage backbone, for example, an M13 phage backbone, and a multiple cloning site for insertion of a nucleic acid sequence encoding a gene of interest. In some embodiments, the vector or a replication product thereof can be packaged into infectious phage particles in the presence of other phage functions by suitable host cells. In some embodiments, the vector or a replication product thereof lacks at least one gene required for the generation of infectious particles.

In some embodiments, the kit comprises (b) an accessory plasmid comprising a nucleic acid sequence encoding the at least one gene required for the generation of infectious particles under the control of a conditional promoter that is activated by a transcriptional activator.

In some embodiments, the kit further comprises a helper phage providing all phage functions except for the at least one gene required for the generation of infectious phage particles provided by the accessory plasmid of (b). In some embodiments, the helper phage or a replication product thereof cannot be packaged into infectious phage particles.

In some embodiments, the kit comprises suitable host cells. In some embodiments, the host cells are E. coli host cells. In some embodiments, the kit further comprises a mutagenesis plasmid. In some embodiments, the mutagenesis plasmid comprising a gene expression cassette encoding umuC (a components of E. coli translesion synthesis polymerase V), dam (deoxyadenosine methylase), and/or seqA (a hemimethylated-GATC binding domain), or any combination thereof.

In some embodiments, a PACE apparatus is provided, comprising a lagoon that is connected to a turbidostat comprising a host cell as described herein. In some embodiments, the host cell is an E. coli host cell. In some embodiments, the host cell comprises a mutagenesis expression construct as described herein, an accessory plasmid as described herein, and optionally, a helper plasmid as described herein, or any combination thereof. In some embodiments, the lagoon further comprises a selection phage as described herein, for example, a selection phage encoding a gene of interest. In some embodiments, the lagoon is connected to a vessel comprising an inducer for a mutagenesis plasmid, for example, arabinose. In some embodiments, the host cells are E. coli cells comprising the F' plasmid, for example, cells of the genotype F'proA$^+$B$^+$ Δ(lacIZY) zzf::Tn10(TetR)/endA1 recA1 galE15 galK16 nupG rpsL ΔlacIZYA araD139 Δ(ara,leu)7697 mcrA Δ(mrr-hsdRMS-mcrBC) proBA::pir116λ$^-$.

For example, in some embodiments, a PACE apparatus is provided, comprising a lagoon of about 100 ml, or about 1 l volume, wherein the lagoon is connected to a turbidostat of about 0.5 l, 1 l, or 3 l volume, and to a vessel comprising an inducer for a mutagenesis plasmid, for example, arabinose, wherein the lagoon and the turbidostat comprise a suspension culture of E. coli cells at a concentration of about 5×10$^8$ cells/ml. In some embodiments, the flow of cells through the lagoon is regulated to about 3 lagoon volumes per hour. In some embodiments, cells are removed from the lagoon by continuous pumping, for example, by using a waste needle set at a height of the lagoon vessel that corresponds to a desired volume of fluid (e.g., about 100 ml, in the lagoon. In some embodiments, the host cells are E. coli cells comprising the F' plasmid, for example, cells of the genotype F'proA$^+$B$^+$ Δ(lacIZY) zzf::Tn10(TetR)/endA1 recA1 galE15 galK16 nupG rpsL ΔlacIZYA araD139 Δ(ara,leu)7697 mcrA Δ(mrr-hsdRMS-mcrBC) proBA::pir116λ$^-$.

Some of the embodiments, advantages, features, and uses of the technology disclosed herein will be more fully understood from the Examples below. The Examples are intended to illustrate some of the benefits of the present disclosure and to describe particular embodiments, but are not intended to exemplify the full scope of the disclosure and, accordingly, do not limit the scope of the disclosure.

EXAMPLES

The potency of some exemplary mutagenesis systems provided herein was characterized, as well as the resulting mutational spectrum. Importantly, this system outperforms commonly used in vivo (XL1-Red, mutA, and LF-Pol I strains) and chemical (EMS, MNNG, and 2AP) methods in mutational efficiency and spectrum, and can even achieve mutational potency and spectrum comparable to that of state-of-the-art in vitro mutagenesis methods (such as PCR mutagenesis with Mutazyme II and Taq polymerase variants). We applied this system to two directed evolution case studies in bacteria and bacteriophage, validating their ability to access biomolecule variants with novel properties in shorter time frames and with greater effectiveness than previously described methods. Collectively, this system substantially advances in vivo mutagenesis capabilities and increases the effectiveness of laboratory evolution efforts.

Results

Mutagenesis Plasmid Minimization

Bacteria control the rate of chromosomal substitutions through a series of overlapping mechanisms that can be subdivided into three main pathways: proofreading (reduces mutation rate by a factor of ~$10^2$ substitutions/bp/generation), mismatch repair (reduces mutation rate by ~$10^3$ substitutions/bp/generation), and base selection (reduces mutation rate by ~$10^5$ substitutions/bp/generation) [10] (FIG. 7). These redundant replication maintenance mechanisms collectively account for the basal substitution rate of bacterial chromosomal DNA of ~$10^{-9}$ to $10^{-10}$ substitutions/bp/generation [10]. Based on prior knowledge of dominant mutators alleles that interfere with DNA replication fidelity, we sought to design a series of small-molecule inducible mutagenesis plasmids (MPs) that offer broad mutational spectra and high levels of mutagenesis in bacterial cells.

We recently reported the development and application of an MP for in vivo mutagenesis during phage-assisted continuous evolution (PACE) [11]. This MP increases the mutation rate of the M13 bacteriophage ~100-fold above the basal E. coli mutation rate through the arabinose-induced expression of dnaQ926, a dominant negative variant of the E. coli DNA Pol III proofreading domain. This plasmid additionally provides umuD', umuC and recA730, which together allow for in vivo translesion mutagenesis employing UV light or chemical mutagens. This MP (designated MP1) results in a substitution rate of 7.2×$10^{-5}$ and 5.4×$10^{-8}$ substitutions/bp/generation for M13 phage and E. coli, respectively [11, 12]. This mutation rate, however, is still several orders of magnitude below the mutation rates provided by conventional in vitro mutagenesis techniques [13].

Since we sought to avoid the use of exogenous mutagens, we first minimized MP1 by removing umuD', umuC, and recA730 from MP1 to yield MP2 carrying only dnaQ926, and observed mutation rates in the absence of mutagens to be modestly improved compared to MP1 through a rifampin-resistance assay using the nearly wild-type E. coli MG1655 ΔrecA::apra (Table 1), enabling an average of 3.6×$10^{-7}$ substitutions/bp/generation (FIG. 1A). Since dnaQ926 abrogates the proofreading component of DNA replication, we began assessing additional genes that when expressed from the MP can further enhance mutation rate.

TABLE 1

Summary of all strains used in this study. Strains that were requested from the
Yale Coli Genetic Stock Center (CGSC) show the corresponding strain numbers.

| Strain | CGSC # | Genotype |
| --- | --- | --- |
| MG1655 ΔrecA | 12492 | F⁻ ΔrecA1918::apra, rph-1 λ⁻ |
| CSH101 | 8095 | F' lacI373 lacZ571/ara-600 Δ(gpt-lac)5 relA1 spoT1 thiE1 λ⁻ |
| CSH102 | 8096 | F' lacI373 lacZ572/ara-600 Δ(gpt-lac)5 relA1 spoT1 thiE1 λ⁻ |
| CSH103 | 8097 | F' lacI373 lacZ573/ara-600 Δ(gpt-lac)5 relA1 spoT1 thiE1 λ⁻ |
| CSH104 | 8098 | F' lacI373 lacZ574/ara-600 Δ(gpt-lac)5 relA1 spoT1 thiE1 λ⁻ |
| CSH105 | 8099 | F' lacI373 lacZ575/ara-600 Δ(gpt-lac)5 relA1 spoT1 thiE1 λ⁻ |
| CSH106 | 8100 | F' lacI373 lacZ576/ara-600 Δ(gpt-lac)5 relA1 spoT1 thiE1 λ⁻ |
| S1030 | N/A | F' proA+B+ Δ(lacIZY) zzf::Tn10 lacI$^{Q1}$ P$_{N25}$-tetR luxCDE/ endA1 recA1 galE15 galK16 nupG rpsL ΔlacIZYA araD139 Δ(ara,leu)7697 mcrA Δ(mrr-hsdRMS-mcrBC) proBA::pir116 araE201 ΔrpoZ Δflu ΔcsgABCDEFG ΔpgaC λ⁻ |
| S1021 | N/A | F⁻ endA1 recA1 galE15 galK16 nupG rpsL ΔlacIZYA araD139 Δ(ara,leu)7697 mcrA Δ(mrr-hsdRMS-mcrBC) proBA::pir116 araE201 ΔrpoZ Δflu ΔcsgABCDEFG ΔpgaC λ⁻ |

DNA Methylation State Manipulation Enhances Mutagenesis

Mismatch repair reduces the error rate of bacterial DNA replication by a factor of up to ~10³ [10]. Following daughter strand synthesis, MutSL scan the genome for mismatches that have evaded the base selection and proofreading activities of the E. coli DNA Pol III holoenzyme (FIG. 7). Once recognized, the newly synthesized DNA is nicked by MutH at hemimethylated GATC sequences, then unwound and digested by dedicated helicases and exonucleases. DNA Pol III synthesizes a new strand and Dam methylase methylates the resulting DNA. The deletion of mutS, mutL, or mutH, and the overexpression of dam are known to have a strong mutator effect due to impaired mismatch repair [14].

Figure 8:
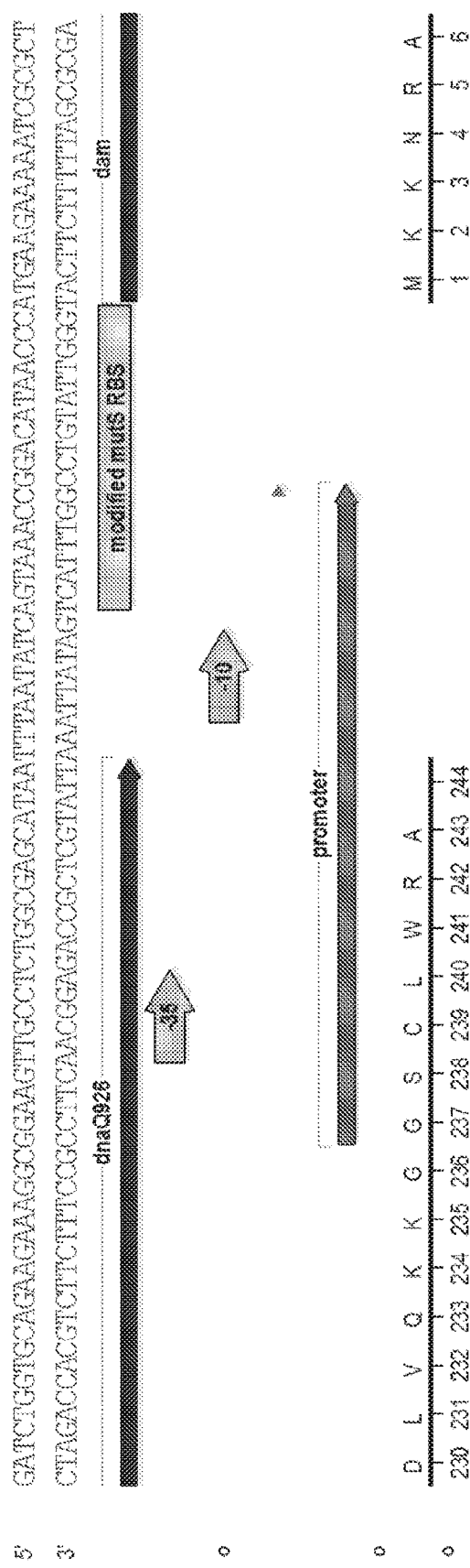
FIG. 8. Cryptic σ$^{70}$ promoter at the 3' end of the dnaQ926 ORF. Annotated sequence of the predicted σ$^{70}$ promoter in MP3 bridging the 3' end of the dnaQ926 ORF and RBS driving the dam ORF. Sequences correspond, from top to bottom, to SEQ ID NOS: 12-15.

We added wild-type dam downstream of dnaQ926 on the same arabinose-inducible expression cassette to yield MP3, and observed increased mutagenesis potency but also increased uninduced background mutagenesis, likely due to a strong cryptic σ⁷⁰ promoter at the 3' end of dnaQ926 (FIG. 8). Overall, MP3 resulted in a 3-fold mutagenesis potency increase in the presence of arabinose relative to MP2 but >60-fold increase in background mutagenesis, greatly reducing the dynamic range of induced mutagenesis to only 11-fold (FIG. 1A).

To restore dynamic range, we installed the gene encoding the hemimethylated GATC-binding domain SeqA downstream of dam. Low-level expression of seqA is known to delay Dam methylation of hemimethylated GATC sequences [15] and induce positive supercoils in chromosomal and episomal DNA [16], which may reduce MP gene transcription in the absence of arabinose. Conversely, high-level seqA expression results in a potent mutator response [17] and induction of negative supercoils in chromosomal and episomal DNA [16], potentially increasing global gene transcription, including that of the MP, upon induction with arabinose. Indeed, the MP carrying dnaQ926, dam, and seqA (MP4) resulted in >60-fold reduced background and 2-fold improved mutagenesis potency in the presence of arabinose relative to MP3, representing a cumulative >100-fold improvement in dynamic range (FIG. 1A).

While the addition of dam and seqA together increased the mutagenic potency by only 4-fold compared to MP2, it is known that dominant-negative dnaQ mutants partially saturate the mismatch repair response [18], Indeed, including dominant-negative variants of mutS [17, 19], mutL [20, 21], or mutH [21] with dnaQ926 had no additional effect on mutagenesis (Tables 2 and 3). Taken together, these results suggest that the inclusion of seqA and dam on MP4 is sufficient to fully disrupt the mismatch repair response, enabling an average of $4.4 \times 10^{-7}$ substitutions/bp/generation by the rifampicin resistance assay.

TABLE 2

Summary of all ORFs carried by the MPs. All MPs use the identical vector backbone: a cloDF13 origin of replication (20-40 copies/cell), a chloramphenicol resistance cassette, the arabinose responsive promoter P$_{BAD}$ driving the mutator genes, and the weak promoter P$_C$ driving araC. Genes carried by each MP are arranged in the order found in the table and are highlighted according to their mechanism of action and/or the canonical repair pathway that they disrupt: proofreading, translesion synthesis, methyl-directed mismatch repair, base excision repair, *base selection* and unknown. Additional optimizations included: codon usage optimization (opt) and increased ribosome-binding site strength (*). Boxes are not drawn to scale. Nucleotide and protein sequences related to the gene symbols listed in the table above are known to those of skill in the art. For gene symbols for which publications are indicated (by superscript numbers), any sequences provided in the publication related to the gene symbol is incorporated herein by reference. In some embodiments, the gene symbols above relate to nucleotide and protein sequences accessible under that gene symbol in any of the National Center for Biotechnology Information (NCBI) databases, for example, in the Nucleotide Reference Sequence (RefSeq) database, release 69 (Jan. 2, 2015), or in the Unigene database available at the time of filing, and any NCBI database entries, e.g., RefSeq database entries for the listed genes in the ResSeq database, release 69, or in the Unigene database at the time of filing, are incorporated herein by reference.

| Name | Genes encoded on the MP (native order) | | | |
| --- | --- | --- | --- | --- |
| MP1 | dnaQ926[40] | umuD' | umuC | recA730[30] |
| MP2 | dnaQ926 | | | |

TABLE 2-continued

Summary of all ORFs carried by the MPs. All MPs use the identical vector backbone: a cloDF13 origin of replication (20-40 copies/cell), a chloramphenicol resistance cassette, the arabinose responsive promoter $P_{BAD}$ driving the mutator genes, and the weak promoter $P_C$ driving araC. Genes carried by each MP are arranged in the order found in the table and are highlighted according to their mechanism of action and/or the canonical repair pathway that they disrupt: proofreading, translesion synthesis, methyl-directed mismatch repair, base excision repair, base selection and unknown. Additional optimizations included: codon usage optimization (opt) and increased ribosome-binding site strength (*). Boxes are not drawn to scale. Nucleotide and protein sequences related to the gene symbols listed in the table above are known to those of skill in the art. For gene symbols for which publications are indicated (by superscript numbers), any sequences provided in the publication related to the gene symbol is incorporated herein by reference. In some embodiments, the gene symbols above relate to nucleotide and protein sequences accessible under that gene symbol in any of the National Center for Biotechnology Information (NCBI) databases, for example, in the Nucleotide Reference Sequence (RefSeq) database, release 69 (Jan. 2, 2015), or in the Unigene database available at the time of filing, and any NCBI database entries, e.g., RefSeq database entries for the listed genes in the ResSeq database, release 69, or in the Unigene database at the time of filing, are incorporated herein by reference.

| Name | Genes encoded on the MP (native order) | | | | |
|---|---|---|---|---|---|
| MP-B2 | dnaE74[42] | | | | |
| MP-B4 | dnaE486[24] | | | | |
| MP-B5 | dnaE1026[43] | | | | |
| MP-C2 | dnaX36[45] | | | | |
| MP-C3 | dnaX2016[45] | | | | |
| MP-D3 | dnaQ926 | dnaE486 | | | |
| MP-D4 | dnaQ926 | dnaE1026 | | | |
| MP-E | dnaQ926 | dnaX36 | | | |
| MP-E2 | dnaQ926 | dnaX2016 | | | |
| MP-F2 | dnaQ926 | mutS538[19] | | | |
| MP-F3 | dnaQ926 | mutS503[19] | | | |
| MP-H | dnaQ926 | mutL705[20] | | | |
| MP-H2 | dnaQ926 | mutL713[20] | | | |
| MP-H3 | dnaQ926 | mutL(R261H)[21] | | | |
| MP-H4 | dnaQ926 | mutL(K307A)[21] | | | |
| MP-I | dnaQ926 | mutH(E56A)[21] | | | |
| MP-I2 | dnaQ926 | mutH(K79E)[21] | | | |
| MP-I3 | dnaQ926 | mutH(K116E)[21] | | | |
| MP-J | rpsD12[47] | | | | |
| MP-J2 | rpsD14[47] | | | | |
| MP-J3 | rpsD16[47] | | | | |
| MP3 | dnaQ926 | dam[48] | | | |
| MP-K7 | dnaQ926 | dam | emrR[17] | | |
| MP4 | dnaQ926 | dam | seqA[17] | | |
| MP-K9 | dnaQ926 | dam | mutSΔN[17] | | |
| MP-K10 | dnaQ926 | dam | seqA | emrR | |
| MP-K11 | dnaQ926 | dam | seqA | mutSΔN | |
| MP-K12 | dnaQ926 | dam | seqA | dinB[42] | |
| MP-K13 | dnaQ926 | dam | seqA | polB[52] | |
| MP-K14 | dnaQ926 | dam | seqA* | | |
| MP-L | polB | | | | |
| MP-L2 | polB(D156A)[52] | | | | |
| MP-P | dnaQ926 | dam | seqA | emrR | mutH(E56A) |
| MP-P3 | dnaQ926 | dam | seqA | emrR | mutL713 |
| MP-P4 | dnaQ926 | dam | seqA | emrR | mutS503 |
| MP-P5 | dnaQ926 | dam | seqA | emrR | mutSΔN |
| MP-P6 | dnaQ926 | dam | seqA | emrR | dinB |
| MP-P7 | dnaQ926 | dam | seqA | emrR | polB |
| MP-P8 | dnaQ926 | dam | seqA | emrR | Ugi[41] | AID[22] |
| MP-P9 | dnaQ926 | dam | seqA | emrR | Ugi | APOBEC1[22] |
| MP6 | dnaQ926 | dam | seqA | emrR | Ugi | CDA1[22] |
| MP-P11 | dnaQ926 | dam | seqA | emrR | Ugi | CDA1 | mutSΔN |
| MP-Q | dnaQ926 | dam | seqA | rsmE[44] | |
| MP-Q2 | dnaQ926 | dam | seqA | cchA[44] | |
| MP-Q3 | dnaQ926 | dam | seqA | yffI[44] | |
| MP-Q4 | dnaQ926 | dam | seqA | yfjY[17] | |
| MP-Q5 | dnaQ926 | dam | seqA | ugi | AID |
| MP-Q6 | dnaQ926 | dam | seqA | ugi | APOBEC1 |
| MP5 | dnaQ926 | dam | seqA | ugi | CDA1 |
| MP-Q8 | dnaQ926 | dam | seqA | nrdAB[25] | |
| MP-Q9 | dnaQ926 | dam | seqA | nrdA(H59A)B[25] | |
| MP-Q10 | dnaQ926 | dam | seqA | nrdA(A65V)B[46] | |
| MP-Q11 | dnaQ926 | dam | seqA | nrdA(A301V)B[46] | |
| MP-Q12 | dnaQ926 | dam | seqA | nrdAB(P334L)[46] | |
| MP-Q13 | dnaQ926 | dam | seqA | nrdEF[25] | |
| MP-R | dnaQ926 | dam | seqA | ugi | AID (opt) |
| MP-R2 | dnaQ926 | dam | seqA | ugi | APOBEC1 (opt) |
| MP-R3 | dnaQ926 | dam | seqA | ugi | CDA1 (opt) |

TABLE 2-continued

Summary of all ORFs carried by the MPs. All MPs use the identical vector backbone: a cloDF13 origin of replication (20-40 copies/cell), a chloramphenicol resistance cassette, the arabinose responsive promoter $P_{BAD}$ driving the mutator genes, and the weak promoter $P_C$ driving araC. Genes carried by each MP are arranged in the order found in the table and are highlighted according to their mechanism of action and/or the canonical repair pathway that they disrupt: proofreading, translesion synthesis, methyl-directed mismatch repair, base excision repair, base selection and unknown. Additional optimizations included: codon usage optimization (opt) and increased ribosome-binding site strength (*). Boxes are not drawn to scale. Nucleotide and protein sequences related to the gene symbols listed in the table above are known to those of skill in the art. For gene symbols for which publications are indicated (by superscript numbers), any sequences provided in the publication related to the gene symbol is incorporated herein by reference. In some embodiments, the gene symbols above relate to nucleotide and protein sequences accessible under that gene symbol in any of the National Center for Biotechnology Information (NCBI) databases, for example, in the Nucleotide Reference Sequence (RefSeq) database, release 69 (Jan. 2, 2015), or in the Unigene database available at the time of filing, and any NCBI database entries, e.g., RefSeq database entries for the listed genes in the ResSeq database, release 69, or in the Unigene database at the time of filing, are incorporated herein by reference.

| Name | Genes encoded on the MP (native order) | | | | | |
|---|---|---|---|---|---|---|
| MP-R4 | dnaQ926 | dam | seqA | emrR | ugi | AID (opt) |
| MP-R5 | dnaQ926 | dam | seqA | emrR | ugi | APOBEC1 (opt) |
| MP-R6 | dnaQ926 | dam | seqA | emrR | ugi | CDA1 (opt) |
| MP-S | dnaQ926 | MAG1[49] | | | | |
| MP-S2 | dnaQ926 | AAG(Y127I-H136L)[50] | | | | |
| MP-S3 | dnaQ926 | Δ80-AAG(Y127I-H136L)[50] | | | | |
| MP-T | dnaQ926 | dam | seqA | emrR | ugi | AID(7)[51] |
| MP-T2 | dnaQ926 | dam | seqA | emrR | ugi | AID(7.3)[51] |
| MP-T3 | dnaQ926 | dam | seqA | emrR | ugi | AID(7.3.5)[51] |
| MP-14 | dnaQ926 | dam | seqA | emrR | ugi | AID(7.3.3)[51] |
| MP-T5 | dnaQ926 | dam | seqA | emrR | ugi | AID(7.3.1)[51] |
| MP-16 | dnaQ926 | dam | seqA | emrR | ugi | AID(7.3.2)[51] |
| MP-U | dnaQ926* | dam | seqA | emrR | ugi | CDA1 |
| MP-U2 | dnaQ926 | dam* | seqA | emrR | ugi | CDA1 |
| MP-U3 | dnaQ926 | dam | seqA | emrR* | ugi | CDA1 |
| MP-U4 | dnaQ926 | dam | seqA | emrR | ugi | CDA1* |
| MP-V | BR13[53] | dam | seqA | emrR | ugi | CDA1 |
| MP-V2 | BRM1[53] | dam | seqA | emrR | ugi | CDA1 |
| MP-V3 | BR11[53] | dam | seqA | emrR | ugi | CDA1 |
| MP-V4 | BR6[53] | dam | seqA | emrR | ugi | CDA1 |
| MP-V5 | BR1[53] | dam | seqA | emrR | ugi | CDA1 |

TABLE 3

Summary of induced and uninduced mutagenesis levels for all designed MPs.
All MPs were tested using the rifampin resistance assay to assess their relative mutagenic load under uninduced (glucose) and induced (arabinose) conditions. The viability of the MP-carrying strains under the induced conditions (as a percentage of the viability of the strain without an MP) is also shown. Ideal MPs show low background and high induced mutagenesis, with only moderate reductions in viability.

| Name | Uninduced $\mu_{bp}$ | Induced $\mu_{bp}$ | Viability (%) |
|---|---|---|---|
| None | 1.20E−10 | 2.20E−11 | 100 |
| MP1 | 3.00E−09 | 2.40E−07 | 87.5 |
| MP2 | 1.00E−09 | 3.60E−07 | 136.8 |
| MP-B2 | 0.00E+00 | 0.00E+00 | 25.4 |
| MP-B4 | 0.00E+00 | 0.00E+00 | 45.8 |
| MP-B5 | 0.00E+00 | 0.00E+00 | 55.9 |
| MP-C2 | 0.00E+00 | 0.00E+00 | 63.6 |
| MP-C3 | 0.00E+00 | 0.00E+00 | 53.4 |
| MP-D3 | 0.00E+00 | 8.50E−09 | 24.2 |
| MP-D4 | 0.00E+00 | 9.50E−09 | 68.6 |
| MP-E | 0.00E+00 | 7.80E−10 | 61 |
| MP-E2 | 1.50E−09 | 2.50E−09 | 40.7 |
| MP-F2 | 3.60E−09 | 9.80E−09 | 48.3 |
| MP-F3 | 0.00E+00 | 1.70E−08 | 73.7 |
| MP-H | 0.00E+00 | 2.60E−08 | 94.1 |
| MP-H2 | 2.60E−09 | 3.50E−08 | 35.6 |
| MP-H3 | 4.70E−10 | 1.00E−08 | 71.2 |
| MP-H4 | 0.00E+00 | 7.40E−09 | 63.6 |
| MP-I | 0.00E+00 | 1.60E−08 | 61 |
| MP-I2 | 0.00E+00 | 6.40E−09 | 83.9 |
| MP-I3 | 0.00E+00 | 1.00E−08 | 89 |
| MP-J | 0.00E+00 | 0.00E+00 | 223.7 |
| MP-J2 | 0.00E+00 | 0.00E+00 | 142.4 |
| MP-J3 | 0.00E+00 | 0.00E+00 | 137.3 |
| MP3 | 6.40E−08 | 9.70E−07 | 31.2 |
| MP-K7 | 2.40E−09 | 3.30E−07 | 9.4 |
| MP4 | 1.00E−09 | 1.60E−06 | 22.9 |
| MP-K9 | 5.70E−09 | 3.30E−07 | 23.4 |
| MP-K10 | 4.10E−11 | 1.10E−07 | 80.6 |
| MP-K11 | 3.60E−10 | 6.80E−08 | 63.6 |
| MP-K12 | 9.80E−10 | 5.40E−08 | 86.4 |
| MP-K13 | 0.00E+00 | 6.70E−08 | 63.6 |
| MP-K14 | 4.10E−09 | 0.00E+00 | 0.8 |
| MP-L | 0.00E+00 | 0.00E+00 | 129.7 |
| MP-L2 | 0.00E+00 | 0.00E+00 | 93.8 |
| MP-P | 1.90E−09 | 1.40E−08 | 144.9 |
| MP-P3 | 4.20E−09 | 9.20E−07 | 33.3 |
| MP-P4 | 1.70E−08 | 5.70E−07 | 81.4 |
| MP-P5 | 1.00E−09 | 2.20E−06 | 26.7 |
| MP-P6 | 1.80E−09 | 4.20E−07 | 10.7 |

TABLE 3-continued

Summary of induced and uninduced mutagenesis levels for all designed MPs.
All MPs were tested using the rifampin resistance assay to assess their relative mutagenic load under uninduced (glucose) and induced (arabinose) conditions. The viability of the MP-carrying strains under the induced conditions (as a percentage of the viability of the strain without an MP) is also shown. Ideal MPs show low background and high induced mutagenesis, with only moderate reductions in viability.

| Name | Uninduced $\mu_{bp}$ | Induced $\mu_{bp}$ | Viability (%) |
|---|---|---|---|
| MP-P7 | 1.30E−09 | 2.80E−07 | 83.9 |
| MP-P8 | 2.00E−09 | 4.80E−07 | 32.8 |
| MP-P9 | 1.20E−07 | 2.60E−05 | 2.9 |
| MP6 | 9.00E−09 | 2.30E−05 | 1.7 |
| MP-P11 | 6.10E−09 | 1.90E−05 | 1.4 |
| MP-Q | 1.60E−09 | 4.90E−07 | 14.7 |
| MP-Q2 | 5.70E−09 | 3.40E−07 | 20.6 |
| MP-Q3 | 8.70E−10 | 3.40E−07 | 16.8 |
| MP-Q4 | 7.10E−09 | 9.70E−07 | 15 |
| MP-Q5 | 7.00E−09 | 4.00E−07 | 22.5 |
| MP-Q6 | 3.60E−09 | 6.70E−07 | 16.3 |
| MP5 | 1.80E−08 | 7.40E−06 | 3.8 |
| MP-Q8 | 6.20E−10 | 1.80E−07 | 37.4 |
| MP-Q9 | 9.20E−10 | 6.90E−08 | 73.7 |
| MP-Q10 | 8.30E−09 | 3.80E−08 | 81.4 |
| MP-Q11 | 4.30E−10 | 4.20E−08 | 66.1 |
| MP-Q12 | 8.80E−10 | 2.00E−08 | 144.9 |
| MP-Q13 | 1.50E−09 | 1.60E−08 | 101.7 |
| MP-R | 3.50E−09 | 6.00E−07 | 13.9 |
| MP-R2 | 2.80E−08 | 8.70E−07 | 13.1 |
| MP-R3 | 4.10E−08 | 4.30E−06 | 4.3 |
| MP-R4 | 8.60E−09 | 2.50E−06 | 3.7 |
| MP-R5 | 1.80E−07 | 1.60E−05 | 5.8 |
| MP-R6 | 2.10E−08 | 6.30E−05 | 0.7 |
| MP-S | 1.20E−10 | 2.30E−08 | 115.3 |
| MP-S2 | 6.30E−11 | 2.10E−08 | 313 |
| MP-S3 | 2.50E−10 | 9.80E−08 | 428.4 |
| MP-T | 7.00E−10 | 1.00E−06 | 13.6 |
| MP-T2 | 7.10E−09 | 3.50E−07 | 23.1 |
| MP-T3 | 3.20E−08 | 5.70E−07 | 12.6 |
| MP-T4 | 2.20E−08 | 8.90E−07 | 13.7 |
| MP-T5 | 2.30E−08 | 6.00E−07 | 21.7 |
| MP-T6 | 9.20E−09 | 8.40E−07 | 16 |
| MP-U | 7.00E−09 | 9.80E−05 | 0.6 |
| MP-U2 | 2.90E−09 | 1.10E−05 | 1.7 |
| MP-U3 | 2.40E−08 | 5.50E−06 | 2.8 |
| MP-U4 | 5.00E−09 | 9.20E−06 | 3.7 |
| MP-V | 1.70E−09 | 5.40E−07 | 5.7 |
| MP-V2 | 2.90E−09 | 1.10E−06 | 7.9 |
| MP-V3 | 1.10E−08 | 2.40E−06 | 3.4 |
| MP-V4 | 5.00E−09 | 2.20E−06 | 4.6 |
| MP-V5 | 8.70E−10 | 1.90E−06 | 6.2 |

Cytosine Deamination and Reduced Base Excision Repair

Overexpression of the catalytic domains of several cytidine deaminases in *E. coli* has been shown to have a mutagenic effect, resulting in primarily C→T transitions through a deoxyuracil intermediate [22]. The cytidine deaminase CDA1 from *Petromyzon marinus* is reported to mediate the efficient mutation of prokaryotic and eukaryotic genomic DNA [22]. Additional mutations or deletion of the *E. coli* uracil-DNA glycosylase ung synergize with the effect of the deaminase and can enhance mutagenesis by disruption of the native uracil-excision repair pathway [22] (FIG. 7). Two natural protein inhibitors of Ung, Ugi and p56 [23], inhibit Ung through mimicry of structural and electronic features of uracil-containing DNA [23]. We hypothesized that the inclusion of a cytidine deaminase and uracil-DNA glycosylase inhibitor would further increase the potency of the MP through impairment of the uracil-excision repair pathway.

Figure 9:
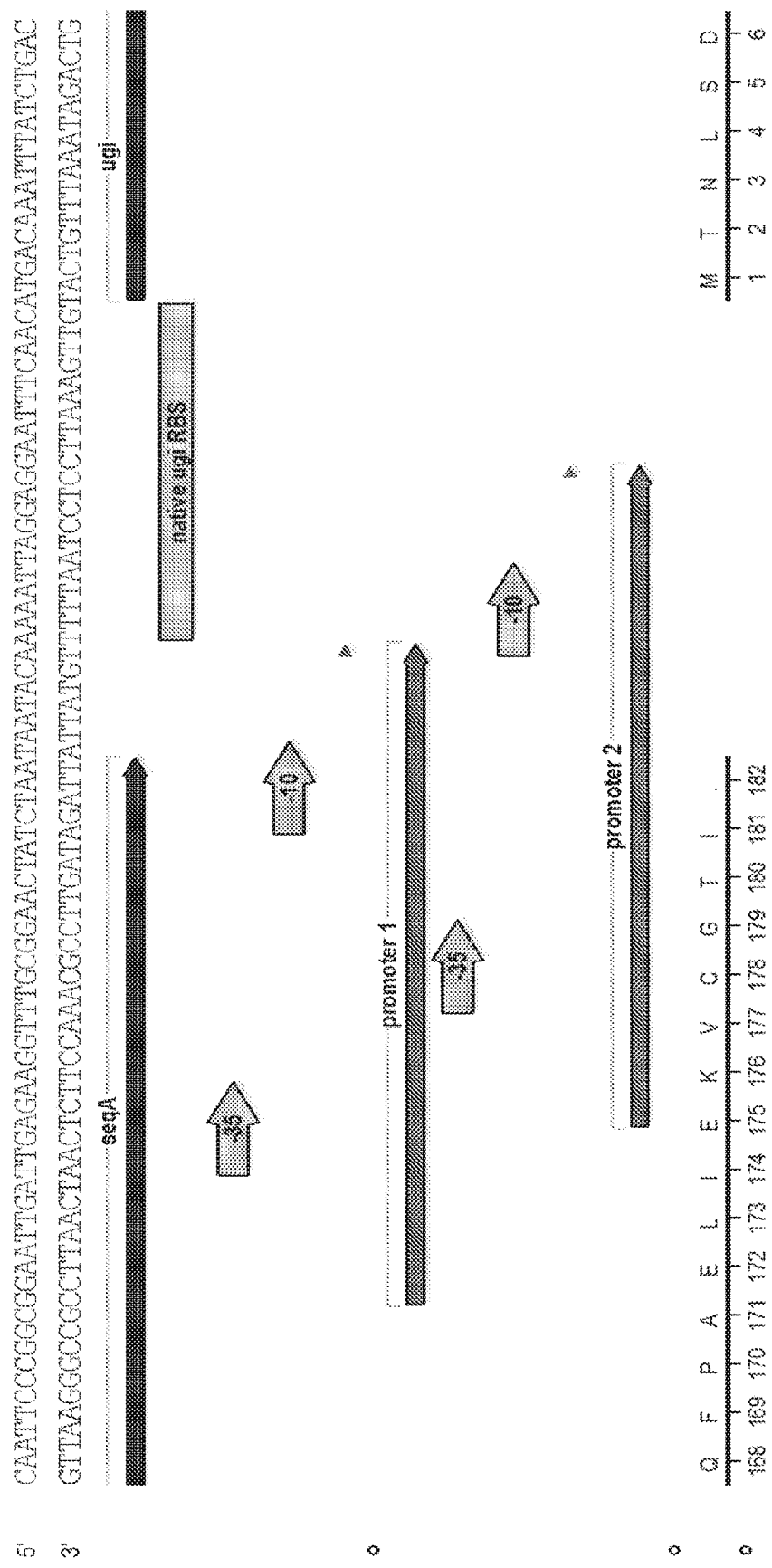
FIG. 9. Cryptic σ$^{70}$ promoters at the 3' end of the seqA ORF. Annotated sequence of the predicted 0 promoters in MP5 bridging the 3' end of the seqA ORF and native RBS driving the ugi ORF. Sequences correspond, from top to bottom, to SEQ ID NOS: 16-19.

We placed ugi and cda1 downstream of dnaQ926, dam and seqA to yield MP5, and observed a 5-fold mutagenesis potency increase under induced conditions, representing an 18-fold increase in background mutagenesis compared to MP4 (FIG. 1A). This background increase was caused by two predicted $\sigma^{70}$ promoters at the 3' end of the seqA open reading frame, resulting in constitutive ugi and cda1 transcription (FIG. 9). We considered this background mutation rate for MP5 to be acceptable, as it was only ~5-fold higher than the starting MP1. Alternative cytosine deaminases, including rat APOBEC1 and human AID, generally resulted in weaker effects on mutation rate than CDA1, in agreement with previous reports (CDA1>>AID≈APOBEC1) [22] (Tables 2 and 3). Overall, MP5 yielded 2.0×10⁻⁶ substitutions per bp per generation, a 31-fold increase in mutation rate relative to MP1 (Tables 2 and 3).

Impairing Mutagenic Nucleobase Export

Two major determinants of base selection during DNA replication are the catalytic alpha subunit of *E. coli* DNA Pol III, and regulation of the intracellular pools of dNTPs available during replication (FIG. 7). Mutations affecting the former are generally not viable or exert a mutator effect through reduced affinity to the proofreading domain, DnaQ [24], whereas perturbations affecting the latter are generally more tolerated and can be modified to affect the mutational spectrum [25]. We screened a number of mutator proteins that are known to compromise intracellular dNTP pools, and found overexpression of the emrR transcriptional repressor to be the most promising (FIG. 1A; Tables 2 and 3).

TABLE 4

Comparison of MP1-MP6 with previously described mutator plasmids.

| Source organism | Gene(s) | Fraction Rif$^R$ | | $\mu_{bp}$ (bp$^{-1}$ generation$^{-1}$) | | | Dynamic | | |
|---|---|---|---|---|---|---|---|---|---|
| | | −MP | +MP | −MP | +MP | Fold | vs MP6 (%) | range* | Ref. |
| Ec | Dam | 8.10E+08 | 3.00E−07 | 2.03E+07 | 7.53E−09 | 0 | 0 | — | 48 |
| Ec | dnaE173 | 5.00E−09 | 7.20E−06 | 1.26E−10 | 1.81E−07 | 1440 | 1 | 24 | 24 |
| Ec | dnaQ926 | 3.00E−08 | 3.47E−04 | 7.53E−10 | 8.71E−06 | 11567 | 38 | — | 40 |
| Ec | mutD5 | 3.00E−08 | 5.70E−05 | 7.53E−10 | 1.43E−06 | 1900 | 6 | — | 40 |
| Sc | mag1 | 5.13E−08 | 3.61E−06 | 1.29E−09 | 9.06E−08 | 70 | 0 | — | 49 |
| Sc | mag1 | 1.00E−08 | 2.00E−06 | 2.51E−10 | 5.02E−08 | 200 | 0 | 200 | 54 |
| Ec | dinB | 4.00E−08 | 4.55E−06 | 1.00E−09 | 1.14E−07 | 114 | 0 | 114 | 55 |
| Ec | dnaE (K655Y) | 1.00E−08 | 8.45E−06 | 2.51E−10 | 2.12E−07 | 845 | 1 | — | 42 |
| Hs | AID | 1.30E−08 | 1.03E−07 | 3.26E−10 | 2.59E−09 | 8 | 0 | 8 | 56 |
| Rn | APOBEC1 | 2.53E−08 | 1.23E−05 | 6.36E−10 | 3.09E−07 | 486 | 1 | 14 | 57 |
| Rn | APOBEC2 | 2.53E−08 | 2.50E−08 | 6.36E−10 | 6.28E−10 | 1 | 0 | — | 57 |
| Hs | AID | 2.53E−08 | 1.66E−07 | 6.36E−10 | 4.17E−09 | 7 | 0 | — | 57 |
| Hs | APOBEC3C | 2.53E−08 | 2.93E−07 | 6.36E−10 | 7.35E−09 | 12 | 0 | — | 57 |
| Hs | APOBEC3G | 2.53E−08 | 2.70E−07 | 6.36E−10 | 6.78E−09 | 11 | 0 | — | 57 |
| Ec | mutH (E56A) | 4.40E−08 | 8.74E−06 | 1.10E−09 | 2.19E−07 | 199 | 1 | — | 21 |

TABLE 4-continued

Comparison of MP1-MP6 with previously described mutator plasmids.

| Source organism | Gene(s) | Fraction Rif$^R$ -MP | Fraction Rif$^R$ +MP | $\mu_{bp}$ (bp$^{-1}$ generation$^{-1}$) -MP | $\mu_{bp}$ (bp$^{-1}$ generation$^{-1}$) +MP | Fold | vs MP6 (%) | Dynamic range* | Ref. |
|---|---|---|---|---|---|---|---|---|---|
| Ec | mutH (K116E) | 4.40E-08 | 8.40E-06 | 1.10E-09 | 2.11E-07 | 191 | 1 | — | 21 |
| Ec | mutH (K79E) | 4.40E-08 | 7.00E-06 | 1.10E-09 | 1.76E-07 | 159 | 1 | — | 21 |
| Ec | mutH (E77A) | 4.40E-08 | 6.94E-06 | 1.10E-09 | 1.74E-07 | 158 | 1 | — | 21 |
| Ec | mutH (D70A) | 4.40E-08 | 6.88E-06 | 1.10E-09 | 1.73E-07 | 156 | 1 | — | 21 |
| Ec | mutH CΔ5 | 4.40E-08 | 9.10E-07 | 1.10E-09 | 2.28E-08 | 21 | 0 | — | 21 |
| Ec | mutL (R95F/N302A) | 4.40E-08 | 1.17E-05 | 1.10E-09 | 2.94E-07 | 267 | 1 | — | 21 |
| Ec | mutL (R261H) | 4.40E-08 | 1.04E-05 | 1.10E-09 | 2.62E-07 | 237 | 1 | — | 21 |
| Ec | mutL (E29A) | 4.40E-08 | 8.32E-06 | 1.10E-09 | 2.09E-07 | 189 | 1 | — | 21 |
| Ec | mutL (K307A) | 4.40E-08 | 6.75E-06 | 1.10E-09 | 1.69E-07 | 153 | 1 | — | 21 |
| Ec | mutL (N302A) | 4.40E-08 | 3.50E-06 | 1.10E-09 | 8.79E-08 | 80 | 0 | — | 21 |
| Ec | mutL (R95F) | 4.40E-08 | 1.27E-07 | 1.10E-09 | 3.19E-09 | 3 | 0 | — | 21 |
| Ec | mutL (K159E) | 4.40E-08 | 7.26E-06 | 1.10E-09 | 1.82E-07 | 165 | 1 | — | 21 |
| Ec | mutL (R266E) | 4.40E-08 | 6.05E-06 | 1.10E-09 | 1.52E-07 | 138 | 1 | — | 21 |
| Ec | mutL (R177E) | 4.40E-08 | 1.77E-06 | 1.10E-09 | 4.44E-08 | 40 | 0 | — | 21 |
| Ec | mutL (I90R) | 4.40E-08 | 1.56E-07 | 1.10E-09 | 3.92E-09 | 4 | 0 | — | 21 |
| Ec | mutL (R237E) | 4.40E-08 | 1.40E-07 | 1.10E-09 | 3.51E-09 | 3 | 0 | — | 21 |
| Ec | mutL (G238A) | 4.40E-08 | 5.40E-08 | 1.10E-09 | 1.36E-09 | 1 | 0 | — | 21 |
| Ec | mutL (G238D) | 4.40E-08 | 1.03E-05 | 1.10E-09 | 2.59E-07 | 234 | 1 | — | 21 |
| Ec | mutL (I90E) | 4.40E-08 | 1.70E-08 | 1.10E-09 | 4.27E-10 | 0 | 0 | — | 21 |
| Ec | mutS (S668A/T669V) | 4.40E-08 | 1.33E-05 | 1.10E-09 | 3.34E-07 | 303 | 1 | — | 21 |
| Ec | mutS (K620M) | 4.40E-08 | 1.21E-05 | 1.10E-09 | 3.05E-07 | 276 | 1 | — | 21 |
| Ec | mutS (D693A) | 4.40E-08 | 1.15E-05 | 1.10E-09 | 2.90E-07 | 262 | 1 | — | 21 |
| Ec | mutS (E694Q) | 4.40E-08 | 1.13E-05 | 1.10E-09 | 2.84E-07 | 257 | 1 | — | 21 |
| Ec | mutS (E694A) | 4.40E-08 | 8.84E-06 | 1.10E-09 | 2.22E-07 | 201 | 1 | — | 21 |
| Ec | mutS (E694A/S668A/T669V) | 4.40E-08 | 8.02E-06 | 1.10E-09 | 2.01E-07 | 182 | 1 | — | 21 |
| Ec | mutS (D693N) | 4.40E-08 | 5.58E-06 | 1.10E-09 | 1.40E-07 | 127 | 1 | — | 21 |
| Ec | mutS (H760A) | 4.40E-08 | 8.01E-07 | 1.10E-09 | 2.01E-08 | 18 | 0 | — | 21 |
| Ec | mutS (H728A) | 4.40E-08 | 4.48E-07 | 1.10E-09 | 1.12E-08 | 10 | 0 | — | 21 |
| Ec | mutS (F596A) | 4.40E-08 | 3.14E-07 | 1.10E-09 | 7.88E-09 | 7 | 0 | — | 21 |
| Ec | mutS (S612A) | 4.40E-08 | 3.70E-08 | 1.10E-09 | 9.29E-10 | 1 | 0 | — | 21 |
| Ec | mutS (F36A) | 4.40E-08 | 1.06E-05 | 1.10E-09 | 2.66E-07 | 241 | 1 | — | 21 |
| Ec | mutS (E38Q) | 4.40E-08 | 4.19E-06 | 1.10E-09 | 1.05E-07 | 95 | 0 | — | 21 |
| Ec | mutS (D162R/E164R) | 4.40E-08 | 4.30E-06 | 1.10E-09 | 1.08E-07 | 98 | 0 | — | 21 |
| Ec | mutS (R163E) | 4.40E-08 | 3.90E-08 | 1.10E-09 | 9.79E-10 | 1 | 0 | — | 21 |
| Ec | mutS (R197E/R198E) | 4.40E-08 | 1.11E-05 | 1.10E-09 | 2.79E-07 | 253 | 1 | — | 21 |
| Ec | mutS (R197E/R198E/R199E) | 4.40E-08 | 6.15E-06 | 1.10E-09 | 1.54E-07 | 140 | 1 | — | 21 |
| Ec | mutS (E177A) | 4.40E-08 | 1.10E-05 | 1.10E-09 | 2.75E-07 | 249 | 1 | — | 21 |
| Ec | mutS (T115A) | 4.40E-08 | 7.99E-06 | 1.10E-09 | 2.01E-07 | 182 | 1 | — | 21 |
| Ec | Dam | 3.00E-08 | 2.00E-06 | 7.53E-10 | 5.02E-08 | 67 | 0 | — | 17 |
| Ec | emrR | 3.00E-08 | 5.00E-06 | 7.53E-10 | 1.26E-07 | 167 | 1 | — | 17 |
| Ec | mutS* | 3.00E-08 | 3.00E-07 | 7.53E-10 | 7.53E-09 | 10 | 0 | — | 17 |
| Ec | seqA | 3.00E-08 | 8.00E-07 | 7.53E-10 | 2.01E-08 | 27 | 0 | — | 17 |
| Ec | dinB | 3.00E-08 | 3.00E-07 | 7.53E-10 | 7.53E-09 | 10 | 0 | — | 17 |
| Pa | nfxB | 8.00E-08 | 3.50E-06 | 2.01E-09 | 8.79E-08 | 44 | 0 | — | 26 |
| Ll | dnaN | 8.00E-08 | 9.80E-08 | 2.01E-09 | 2.46E-09 | 1 | 0 | — | 26 |
| Ll | dnaA | 8.00E-08 | 1.90E-07 | 2.01E-09 | 4.77E-09 | 2 | 0 | — | 26 |
| Ll | uvrA, ysjE | 8.00E-08 | 3.90E-08 | 2.01E-09 | 9.79E-10 | 0 | 0 | — | 26 |
| Ll | uvrA | 8.00E-08 | 1.10E-07 | 2.01E-09 | 2.76E-09 | 1 | 0 | — | 26 |
| Ll | rnhA, sipL, purR | 8.00E-08 | 4.80E-08 | 2.01E-09 | 1.20E-09 | 1 | 0 | — | 26 |
| Ll | rnhA, sipL | 8.00E-08 | 6.70E-08 | 2.01E-09 | 1.68E-09 | 1 | 0 | — | 26 |
| Ll | rnhA | 8.00E-08 | 1.40E-08 | 2.01E-09 | 3.51E-10 | 0 | 0 | — | 26 |
| Ec | polB | 2.20E-08 | 2.32E-06 | 5.52E-10 | 5.82E-08 | 105 | 0 | 116 | 52 |
| Ec | polB Q779V | 2.20E-08 | 6.14E-08 | 5.52E-10 | 1.54E-09 | 3 | 0 | — | 52 |
| Ec | polB Δ780-783 | 2.20E-08 | 5.93E-08 | 5.52E-10 | 1.49E-09 | 3 | 0 | — | 52 |
| Ec | polB (D156A) | 2.20E-08 | 4.73E-04 | 5.52E-10 | 1.19E-05 | 21478 | 52 | — | 52 |
| Ec | uvrAB | 7.90E-09 | 5.40E-08 | 1.98E-10 | 1.36E-09 | 7 | 0 | — | 58 |
| Ec | uvrABC | 7.90E-09 | 1.90E-07 | 1.98E-10 | 4.77E-09 | 24 | 0 | — | 58 |
| Hs | AID | 1.00E-08 | 1.40E-07 | 2.51E-10 | 3.51E-09 | 14 | 0 | — | 51 |
| Hs | AID (K10E/E156G) | 1.00E-08 | 6.30E-07 | 2.51E-10 | 1.58E-08 | 63 | 0 | — | 51 |
| Hs | AID (K34E/K160E) | 1.00E-08 | 4.20E-07 | 2.51E-10 | 1.05E-08 | 42 | 0 | — | 51 |
| Hs | AID | 2.40E-08 | 4.90E-07 | 6.02E-10 | 1.23E-08 | 20 | 0 | — | 59 |
| Hs | AID-3FL | 2.40E-08 | 3.70E-07 | 6.02E-10 | 9.29E-09 | 15 | 0 | — | 59 |
| Hs | AID-3GL | 2.40E-08 | 1.60E-07 | 6.02E-10 | 4.02E-09 | 7 | 0 | — | 59 |
| Hs | AAG | 1.00E-09 | 2.00E-07 | 2.51E-11 | 5.02E-09 | 200 | 0 | 1 | 50 |
| Hs | AAG(Y127I/H136L) | 1.00E-09 | 1.15E-05 | 2.51E-11 | 2.89E-07 | 11500 | 1 | 4 | 50 |
| Ec | nrdAB | 1.00E-08 | 8.00E-08 | 2.51E-10 | 2.01E-09 | 8 | 0 | — | 25 |
| Ec | nrdEF | 1.00E-08 | 3.50E-07 | 2.51E-10 | 8.79E-09 | 35 | 0 | — | 25 |
| Ec | nrdA(H59A)B | 1.00E-08 | 3.80E-07 | 2.51E-10 | 9.54E-09 | 38 | 0 | — | 25 |
| Hs | APOBEC3G | 2.60E-07 | 2.40E-06 | 6.53E-09 | 6.02E-08 | 9 | 0 | — | 60 |
| Hs | APOBEC3G (E259Q) | 2.60E-07 | 3.60E-07 | 6.53E-09 | 9.04E-09 | 1 | 0 | — | 60 |
| Hs | APOBEC3G (E254R) | 2.60E-07 | 3.50E-06 | 6.53E-09 | 8.79E-08 | 13 | 0 | — | 60 |
| Hs | APOBEC3G (R313E) | 2.60E-07 | 2.60E-07 | 6.53E-09 | 6.53E-09 | 1 | 0 | — | 60 |
| Hs | APOBEC3G (R320E) | 2.60E-07 | 5.80E-07 | 6.53E-09 | 1.46E-08 | 2 | 0 | — | 60 |
| Hs | APOBEC3G (R313E/R320E) | 2.60E-07 | 3.10E-07 | 6.53E-09 | 7.78E-09 | 1 | 0 | — | 60 |

TABLE 4-continued

Comparison of MP1-MP6 with previously described mutator plasmids.

| Source organism | Gene(s) | Fraction Rif$^R$ | | $\mu_{bp}$ (bp$^{-1}$ generation$^{-1}$) | | Fold | vs MP6 (%) | Dynamic range* | Ref. |
|---|---|---|---|---|---|---|---|---|---|
| | | −MP | +MP | −MP | +MP | | | | |
| Hs | APOBEC3G (R374E) | 2.60E−07 | 5.50E−07 | 6.53E−09 | 1.38E−08 | 2 | 0 | — | 60 |
| Hs | APOBEC3G (R376E) | 2.60E−07 | 1.90E−06 | 6.53E−09 | 4.77E−08 | 7 | 0 | — | 60 |
| Hs | APOBEC3G (R374E/R376E) | 2.60E−07 | 6.90E−07 | 6.53E−09 | 1.73E−08 | 3 | 0 | — | 60 |
| Hs | APOBEC3G (R213E) | 2.60E−07 | 4.40E−07 | 6.53E−09 | 1.10E−08 | 2 | 0 | — | 60 |
| Hs | APOBEC3G (R215E) | 2.60E−07 | 3.20E−07 | 6.53E−09 | 8.03E−09 | 1 | 0 | — | 60 |
| Hs | APOBEC3G (R213E/215E) | 2.60E−07 | 2.90E−07 | 6.53E−09 | 7.28E−09 | 1 | 0 | — | 60 |
| Ec | dnaQ926, umuD', umuC, recA730 | 7.35E−09 | 2.15E−05 | 7.10E−11 | 2.36E−07 | 3320 | 1 | 78 | 12 |
| Ec | dnaQ926 | 7.35E−09 | 2.98E−05 | 7.10E−11 | 3.61E−07 | 5087 | 2 | 355 | This work |
| Ec | dnaQ926, dam | 7.35E−09 | 5.54E−05 | 7.10E−11 | 9.74E−07 | 13723 | 4 | 15 | This work |
| Ec | dnaQ926, dam, seqA | 7.35E−09 | 1.03E−04 | 7.10E−11 | 1.60E−06 | 22610 | 7 | 1604 | This work |
| Ec, PBS2, Pm | dnaQ926, dam, seqA, ugi, cda1 | 7.35E−09 | 2.88E−04 | 7.10E−11 | 7.36E−06 | 103749 | 32 | 419 | This work |
| Ec, PBS2, Pm | dnaQ926, dam, seqA, emrR, ugi, cda1 | 7.35E−09 | 4.73E−04 | 7.10E−11 | 2.29E−05 | 322414 | 100 | 34941 | This work |

In each case, the mutator genes are listed with the source organism(s): Ec = *Escherichia coli*; Sc = *Saccharomyces cerevisiae*; Hs = *Homo sapiens*; Rn = *Rattus norvegicus*; Pa = *Pseudomonas aeruginosa*; Ll = *Lactococcus lactis*; PBS2 = *Bacillus subtilis* phage PBS2; Pm = *Petromyzon marinus*.
In all cases, the fraction of cells showing rifampin resistance (Rif$^R$) was used to calculate $\mu_{bp}$ as described in the methods section, using R = 21 sites, N = 10$^8$, and N$_0$ = 1.5 × 10$^7$ to approximate the levels as compared to the MP1-6 series.
The fold increase in mutagenesis is shown for each MP (defined as the ratio of the mutagenesis in the strain without the MP vs. in the strain with the MP).
All MPs are compared to MP6 in total mutagenesis efficiency.
*In cases where the MP was inducible, the dynamic range represents the fold increase between the uninduced and induced states for strains carrying the MP.

Derepression by EmrR results in upregulation of emrAB, which produces a multidrug efflux pump responsible for antibiotic resistance and the putative export of mutagenic nucleobase intermediates [26]. In an unbiased screen, emrR overexpression was found to have a potent mutator effect [17], presumably as a consequence of retaining these mutagenic nucleobases within the cell. To decrease background mutagenesis compared to MP5, we placed the emrR cassette between seqA and ugi, thereby disrupting the strong predicted $\sigma^{70}$ promoter, yielding MP6. MP6 exhibited 2-fold lower background mutagenesis, while improving the overall mutator effect under induced conditions by 3-fold (FIG. 1A).

Features of the MP6 Mutagenesis System and Comparison with Other Methods

We chose MP6 for in-depth characterization because it offered the highest mutagenic potency with acceptable levels of toxicity (>1% of cells surviving under maximal MP induction) under the tested conditions. Efforts to increase the expression level of the six key genes in MP6 resulted in substantially higher toxicity or reduced potency (Tables 2 and 3). When induced, MP6 results in a 322,000-fold increase in mutation rate of chromosomal DNA over that of wild-type *E. coli*, and a 100-fold increase in mutation rate relative to that of MP1. Induced MP6 results in an average of 2.3×10$^{-5}$ substitutions/bp/generation, representing to our knowledge the most potent inducible and genetically encodable mutagenesis method in bacteria reported to date (Table 4). This potency compares favorably to overexpression of PolB (D156A) ($\mu_{bp}$=3.2×10$^{-6}$), dnaQ926 ($\mu_{bp}$=2.4×10$^{-6}$), or mutD5 ($\mu_{bp}$=3.9×10$^{-7}$) (Table 4). We note that most previously published mutagenic constructs suffer from a lack of inducibility, have deleterious effects on host viability, and require overexpression of the mutagenic protein. In contrast, the MPs described here rely on the low-level expression of multiple genes, thereby affecting multiple pathways and enabling broad mutagenic spectra.

Figure 10A:
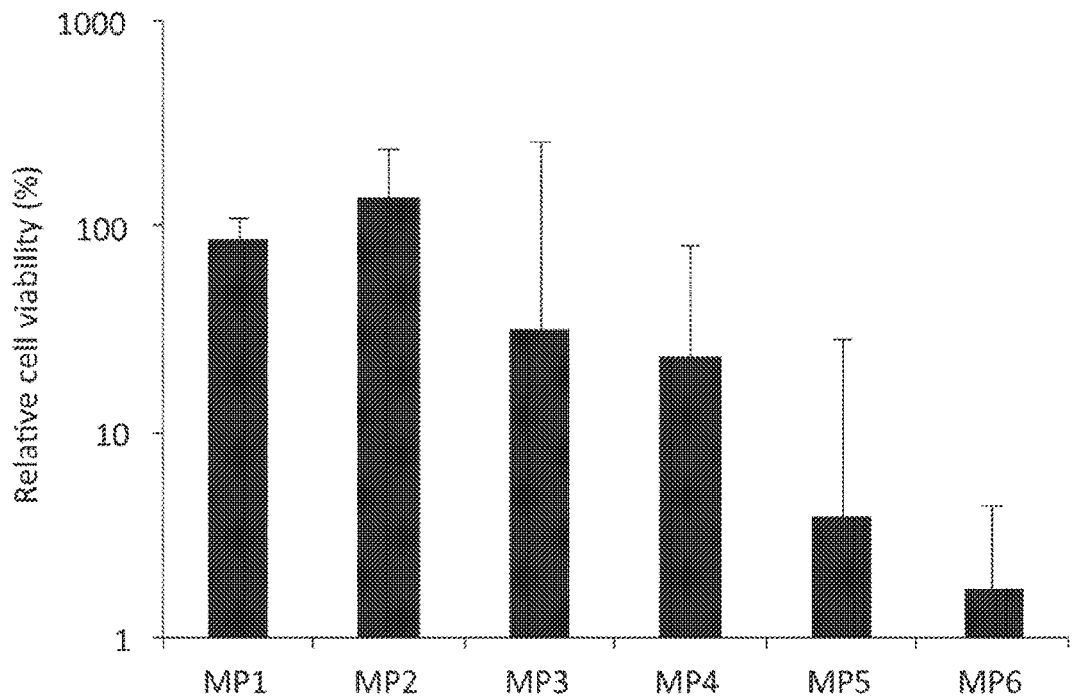
FIGS. 10A-10B. Effect of MPs on host viability under induced conditions.
Figure 10B:
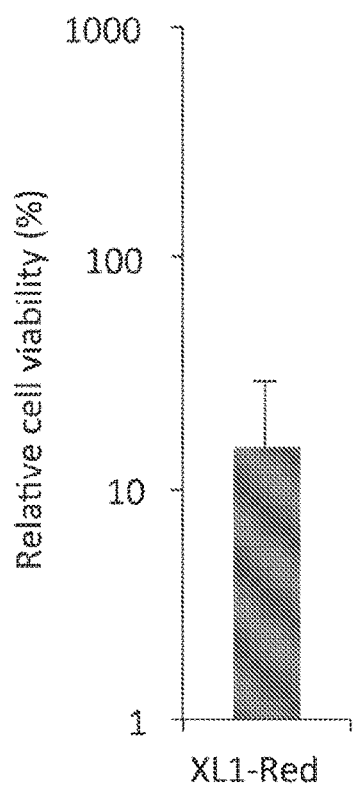
Figure 11:
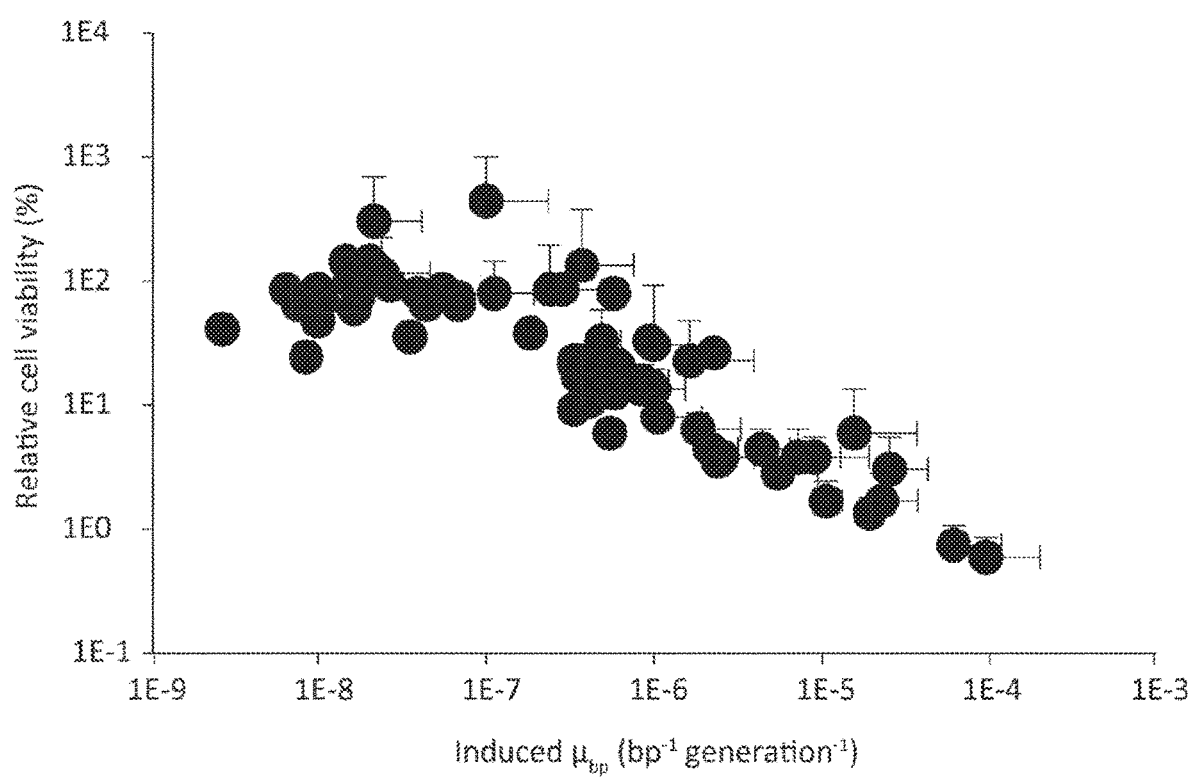
FIG. 11. Relationship between host viability and induced levels of mutagenesis for all MPs. Low potency MPs which induce up to ~1×10$^{-6}$ substitutions/bp/generation were well tolerated by the E. coli MG1655 ΔrecA::apra host, while higher levels of mutagenesis generally resulted in a reduced host viability, as expected. This inflection point corresponds to ~4.6 substitutions/genome/generation for wild-type E. coli MG1566 (genome size=4.64×10$^6$ bp).
Figure 12:
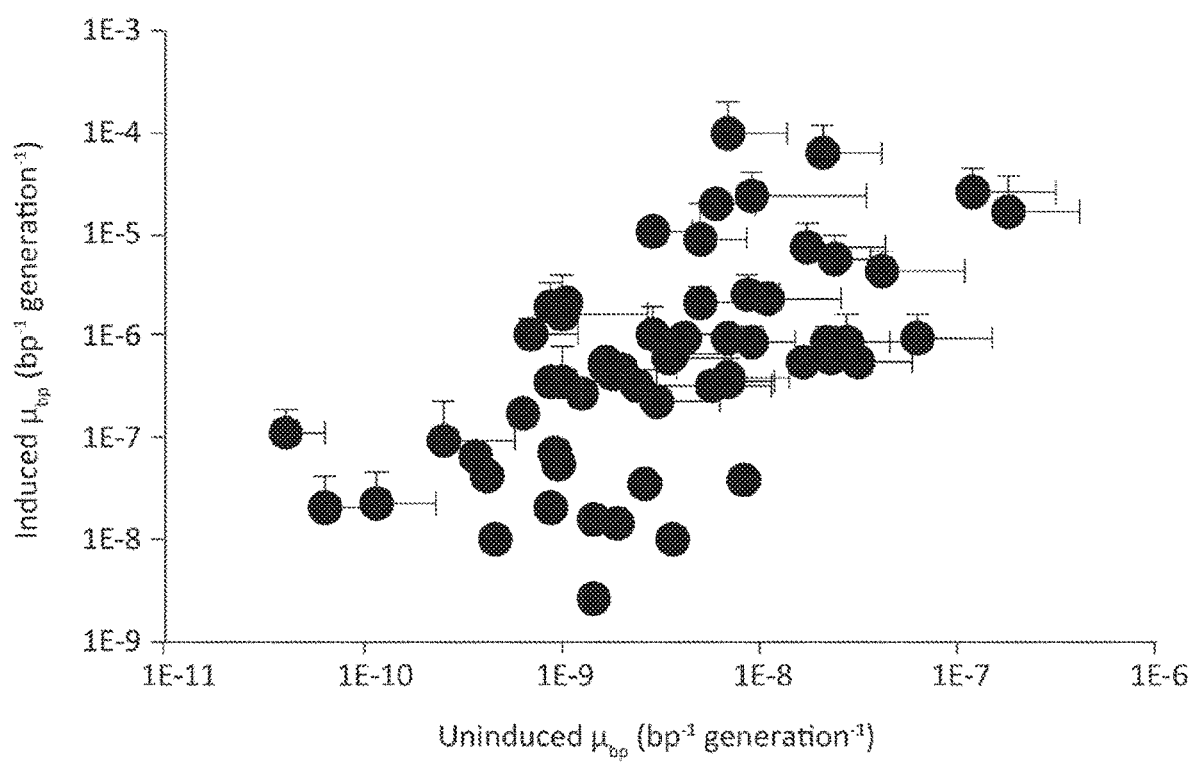
FIG. 12. Relationship between uninduced and induced levels of mutagenesis for all MPs. Higher levels of background (uninduced mutagenesis) were generally accompanied by an increase in overall MP mutagenesis upon induction. The full data set is provided in Table 2.

Additional permutations of this design or the inclusion of alternative mutators impaired overall mutation rate, or strongly decreased host viability, as evidenced by the characteristics of 80 candidate MPs with mutation rates spanning five orders of magnitude (FIGS. 10, 11, and 12; Tables 2 and 3). We observed that a loss of bacterial viability proportional to mutagenic potency beyond a mutation rate of ~4×10$^{-7}$ substitutions per bp per generation, corresponding to an average of ~1.9 substitutions/genome/generation. Given that ~10-30% of the *E. coli* genome has been estimated to be essential [27], this mutation rate threshold corresponds to ~0.2-0.6 mutation in an essential gene/generation.

Next we tested the dynamic range and inducibility of MP6. To limit background mutagenesis, we increased the concentration of glucose from 25 mM to 200 mM during the transformation and growth stages prior to induction to maximize catabolite repression of the arabinose-inducible promoter. Under these modified conditions, induction of log-phase cultures of MG1655 ΔrecA::apra carrying MP6 with increasing concentrations of arabinose revealed a 35,000-fold dynamic range between 10 μM and 100 mM arabinose (FIG. 2A). Despite this very strong induction effect, MP6-carrying cultures maintained low levels of mutagenesis when suppressed with 200 mM glucose (FIG. 2A).

Figure 2C:
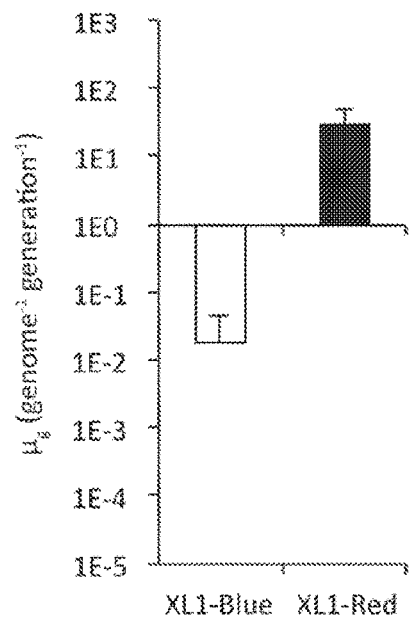
Figure 2B:
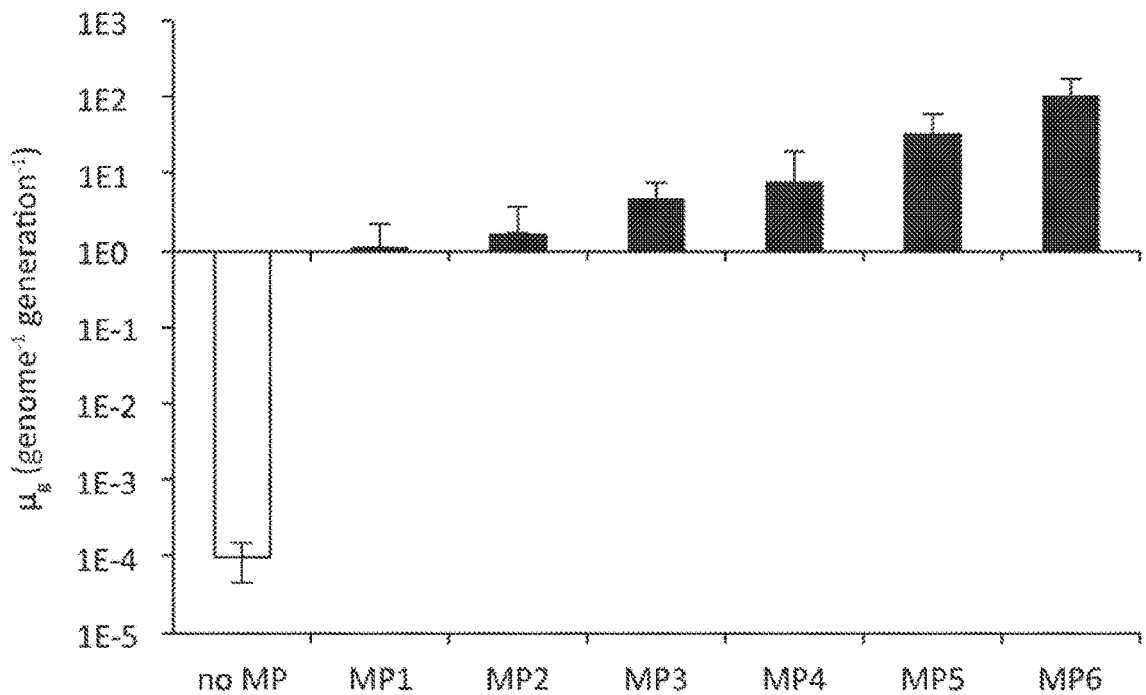

To further evaluate MP6, we compared its performance with that of the most commonly used in vivo mutagenesis strain, XL1-Red (Agilent Technologies). XL1-Red is deficient in proofreading (mutD5), mismatch-repair (mutS) and base-excision (mutT) activities, resulting in high levels of substitutions in chromosomal and episomal DNA [6]. However, the strain grows very slowly, is difficult to manipulate genetically, has poor transformation efficiency, and produces a fairly narrow mutagenic spectrum [7]. Using the rifampin resistance assay, we found that XL1-Red results in 29 substitutions/genome/generation, while MP6 in the induced state produces an average of 110 substitutions/genome/generation, a ~4-fold higher mutation rate (FIGS. 2B, 2C). The uninduced state of MP6 yields similar background mutagenesis levels (0.01 substitutions/genome/generation) as the non-mutagenic related strain XL1-Blue (0.005 substitutions/genome/generation) (FIGS. 1A, 1B, 2C). Together, these results establish that MP6 allows for mutagenesis levels exceeding that of the most commonly used mutator *E. coli* strain, and offers the ability to control mutation rate with an exogenous small molecule.

MP6 Augments M13 Bacteriophage Mutagenesis

Figure 13:
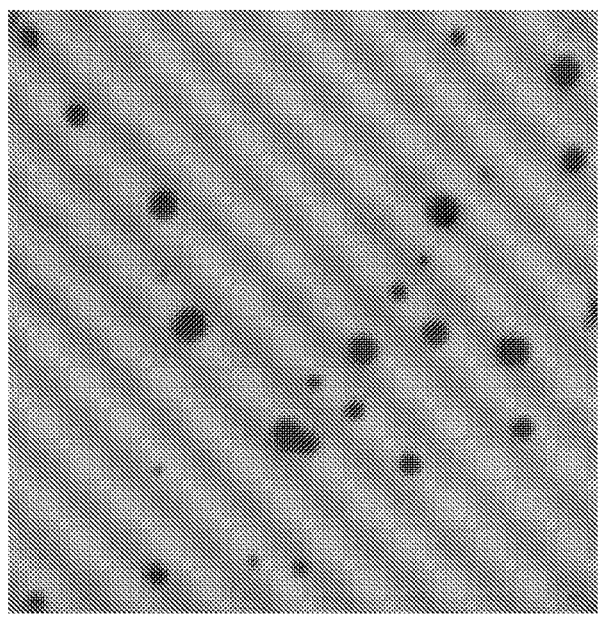
FIG. 13. Plaque assay of the lacZ-carrying M13 phage SP063. SP063 carries the wild-type E. coli β-galactosidase gene with a consensus ribosome-binding site directly downstream of geneIII. Plating using soft agar containing S1030 cells in the presence of the X-Gal analog Bluo-Gal (Life Technologies) results in a strong, deep blue plaques (shown here as dark circles).

To further characterize MP1, MP4, and MP6, we assessed their impact on the mutagenesis of bacteriophage DNA. Phage display is a widely used platform for laboratory screening and evolution efforts, and has been used to generate many proteins with novel or improved activities [28]. We measured the mutagenesis rate of M13 phage in host cells harboring a variety of MP variants or in XL1-Red using a lacZ inactivation assay. Briefly, a lacZ cassette was integrated downstream of geneHII in the wild-type M13 genome to yield SP063, resulting in high-level expression of β-galactosidase and the production of blue plaques in the presence of an X-Gal analog (FIG. 13). Disruption of the lacZ cassette due to high mutagenesis reduces or ablates this blue-plaque phenotype, enabling the estimation of phage mutagenesis rates. We compared the ratio of white:blue plaques (lacZ⁻ phenotype) using MP1, MP4, MP6, and XL1-Red.

Figure 14A:
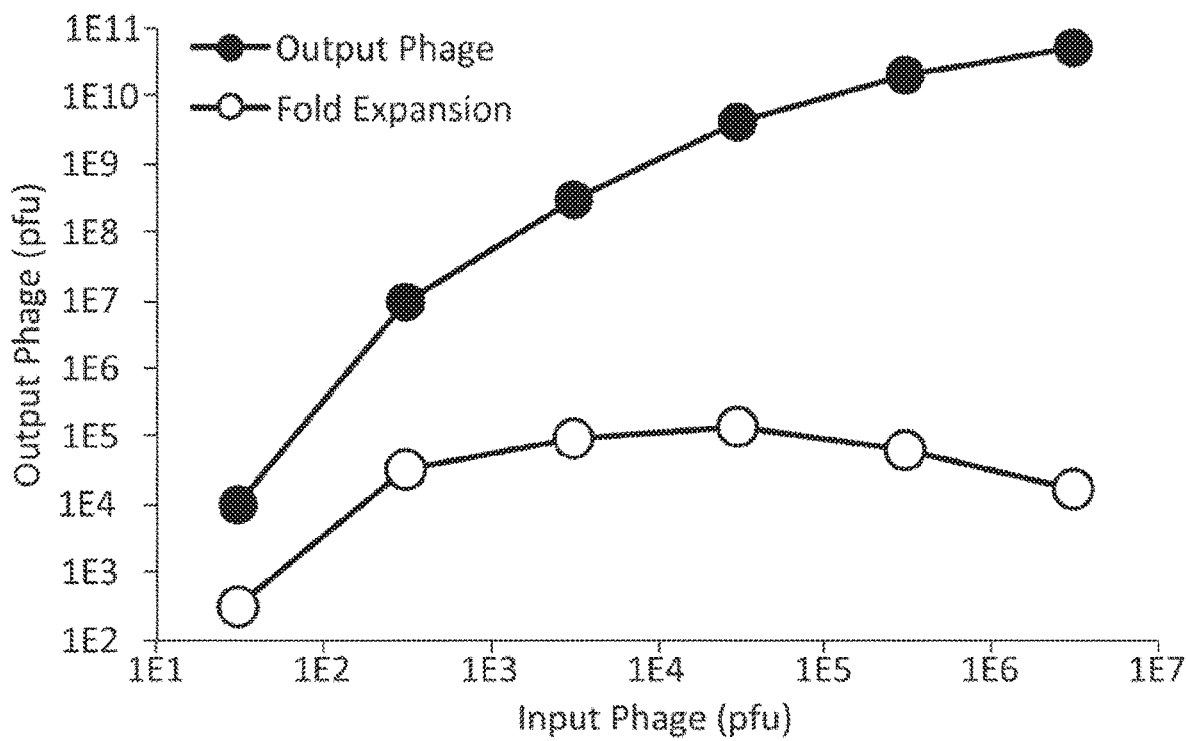
FIGS. 14A-14B. Optimization of phage inoculant for optimal expansion and mutagenesis.
Figure 14B:
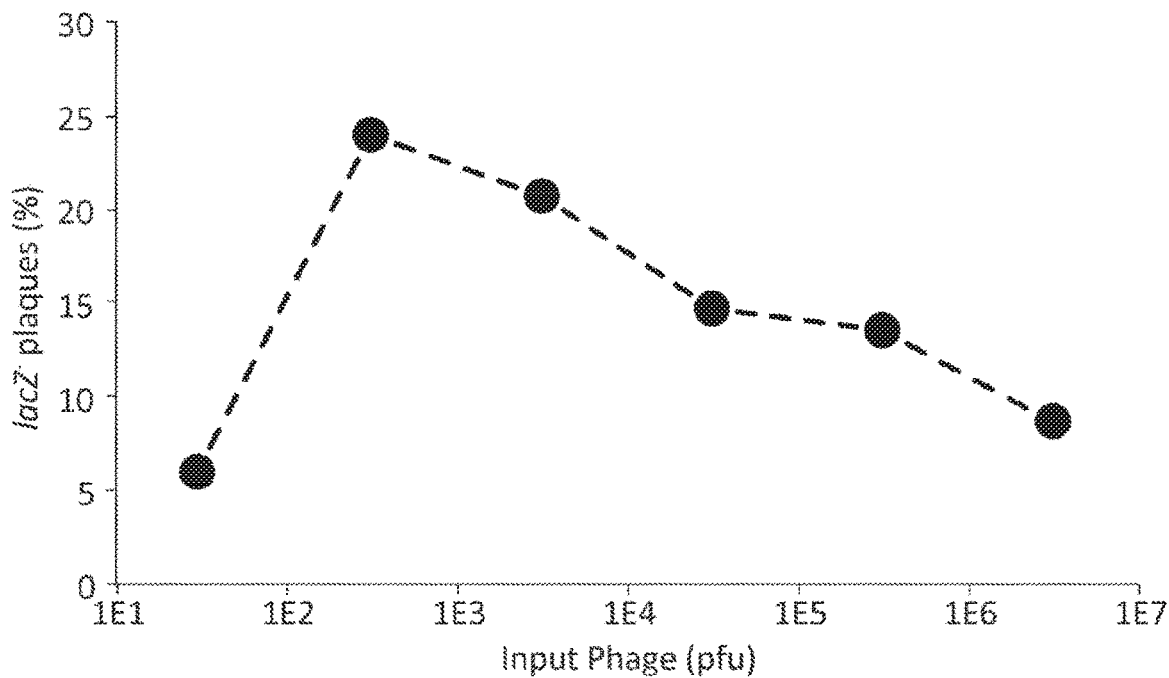

Under conditions supporting phage inoculum expansion in overnight culture using S1030 cells (FIG. 14 and Table 1), we observed that the phage-borne lacZ inactivation rates scaled with MP potency, reaching up to 27% white plaques (representing mutant, inactive lacZ genes) after 18 to 24 h of culture with MP6 (FIG. 3A). As MP6 increases the rate of mutagenesis by ~100-fold as compared to MP1, the expected M13 bacteriophage mutation rate is elevated to $7.2 \times 10^{-3}$ substitutions/bp/generation [11], resulting in an average of 22 substitutions/genome/generation in the SP063 phage. This mutagenesis potency of 2.3 substitutions/kb (0.23%) approaches the potency of the most commonly used in vitro mutagenesis methods, Mutazyme II (0.3%-1.6%, Agilent Technologies).

Figure 15A:
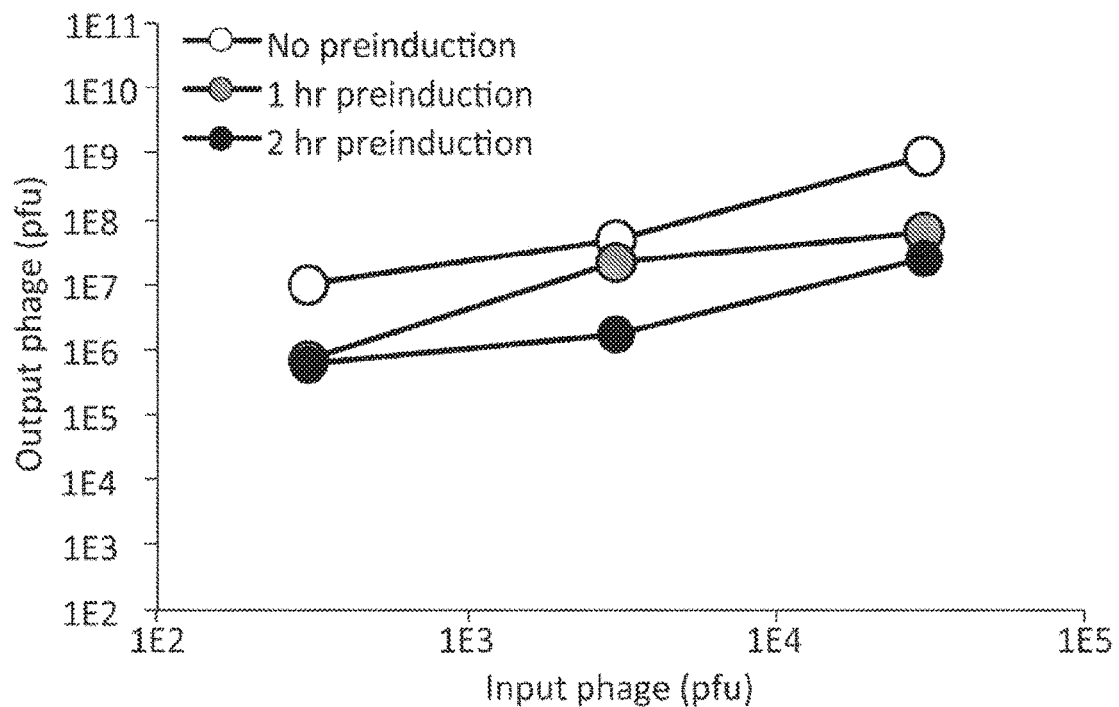
FIGS. 15A-15B. Effect of MP pre-induction on phage mutagenesis.
Figure 15B:
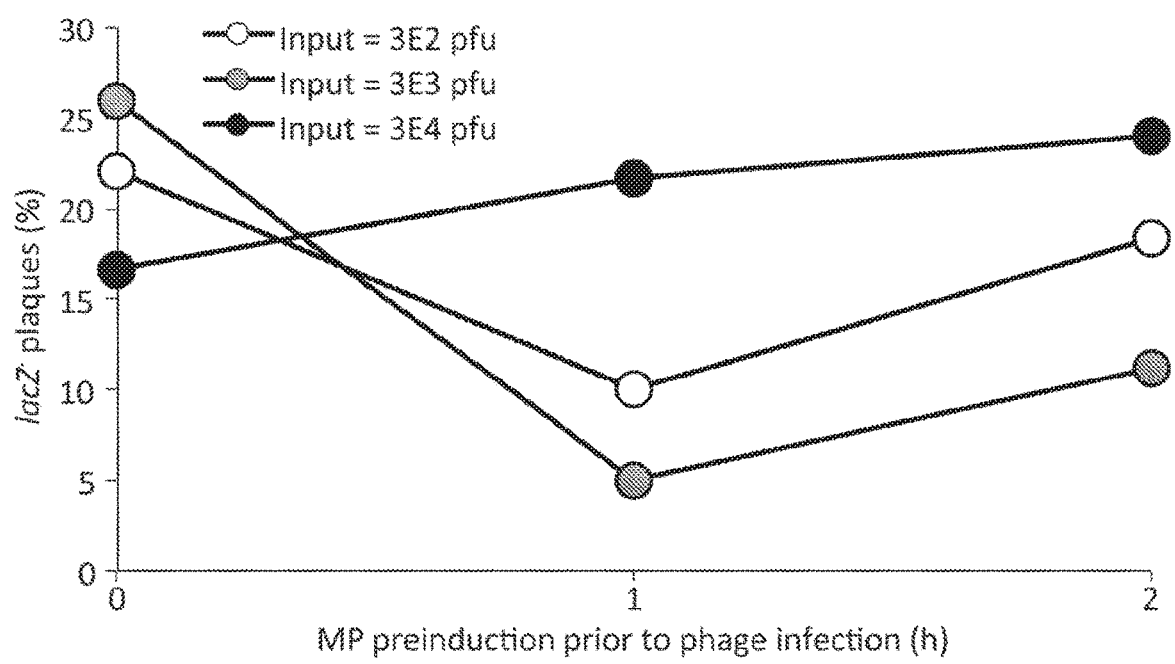

To allow for a comparison to XL1-Red, which lacks an F' episome and thus cannot be infected by M13 phage particles but allows for the production of fully functional phage, purified SP063 dsDNA was transformed into S1021 (the F⁻ variant of S1030, Table 1) cells carrying the aforementioned MPs (induced prior to or after SP063 transformation, or both; FIG. 15) or XL1-Red. Whereas phage produced from transformed XL1-Red cells only yielded an average of 5% white plaques on S1030 cells (FIG. 3B), phage produced from the S1021 strain carrying MP6 yielded 15% white plaques and MP1 and MP4 yielded 7% and 10% white plaques, respectively, on S1030 cells (FIG. 3C). These results further demonstrate the greater mutational potency of MP6 compared to that of XL1-Red, and also highlight the strain flexibility achieved by using inducible, genetically encodable mutagenesis systems.

Mutational Spectra of Designed MPs

Figure 4A:
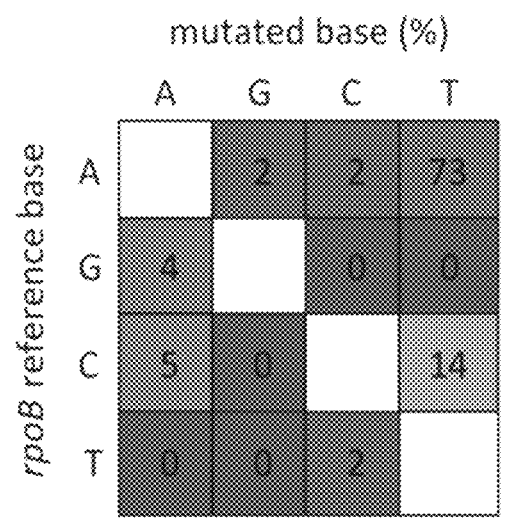
FIGS. 4A-4I. Mutagenic spectra of the MPs.
Figure 4B:
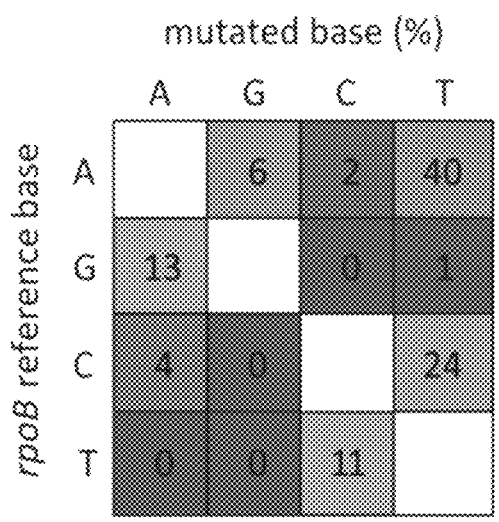
Figure 4C:
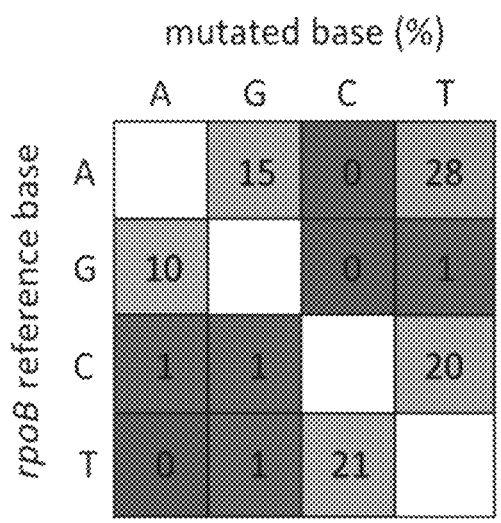
Figure 4D:
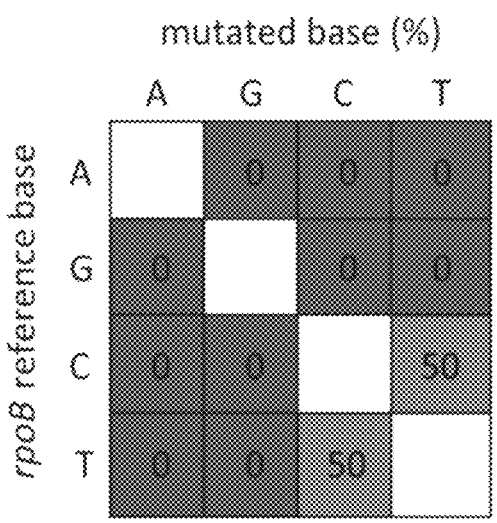
Figure 4E:
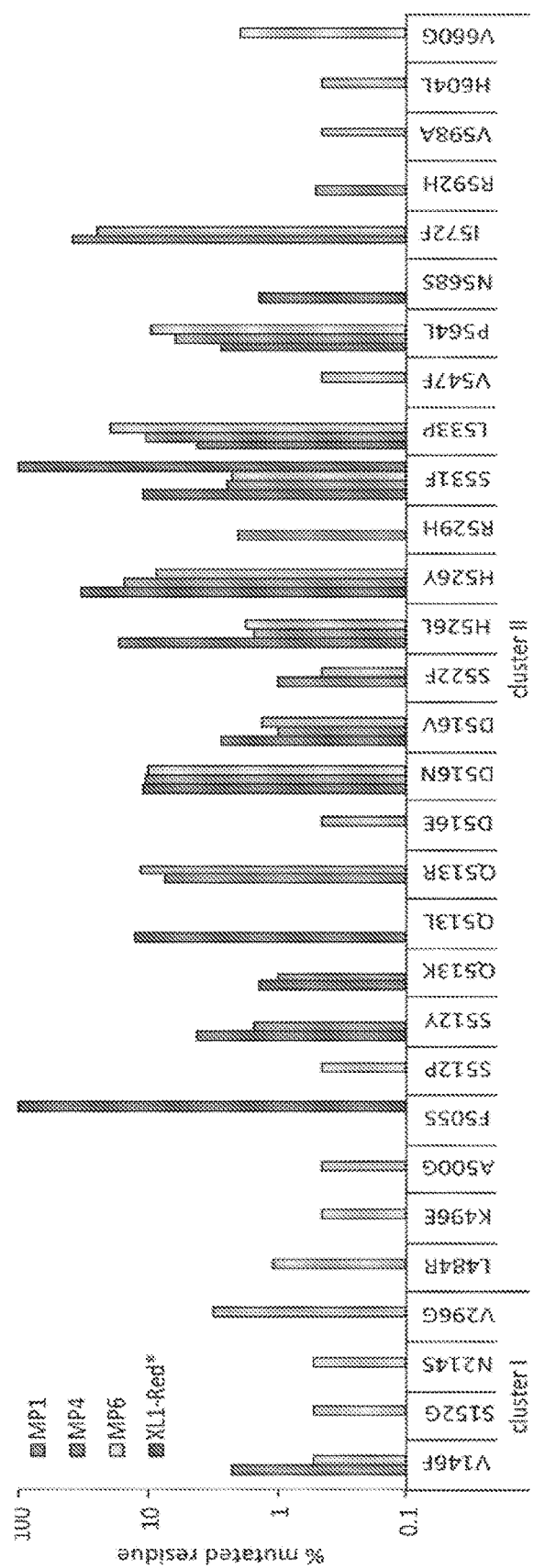
Figure 4F:
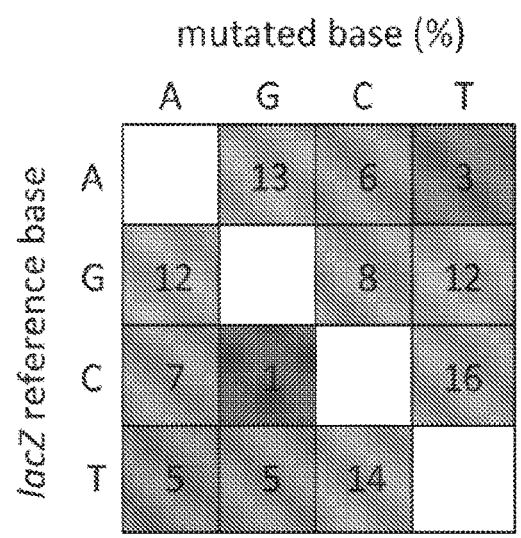
Figure 4G:
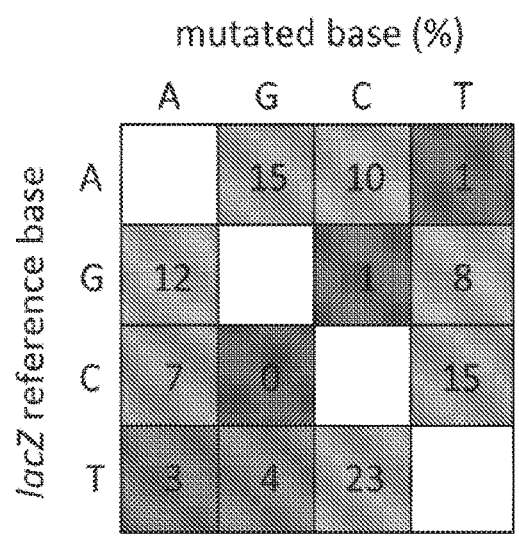
Figure 4H:
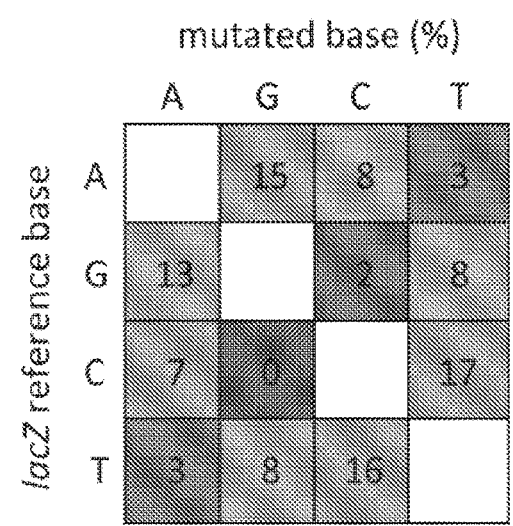
Figure 4I:
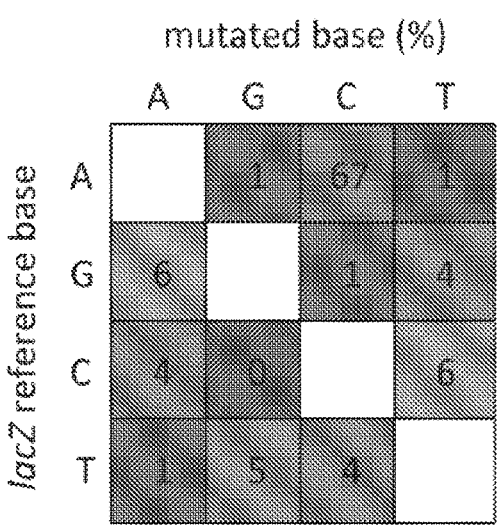
Figure 16:
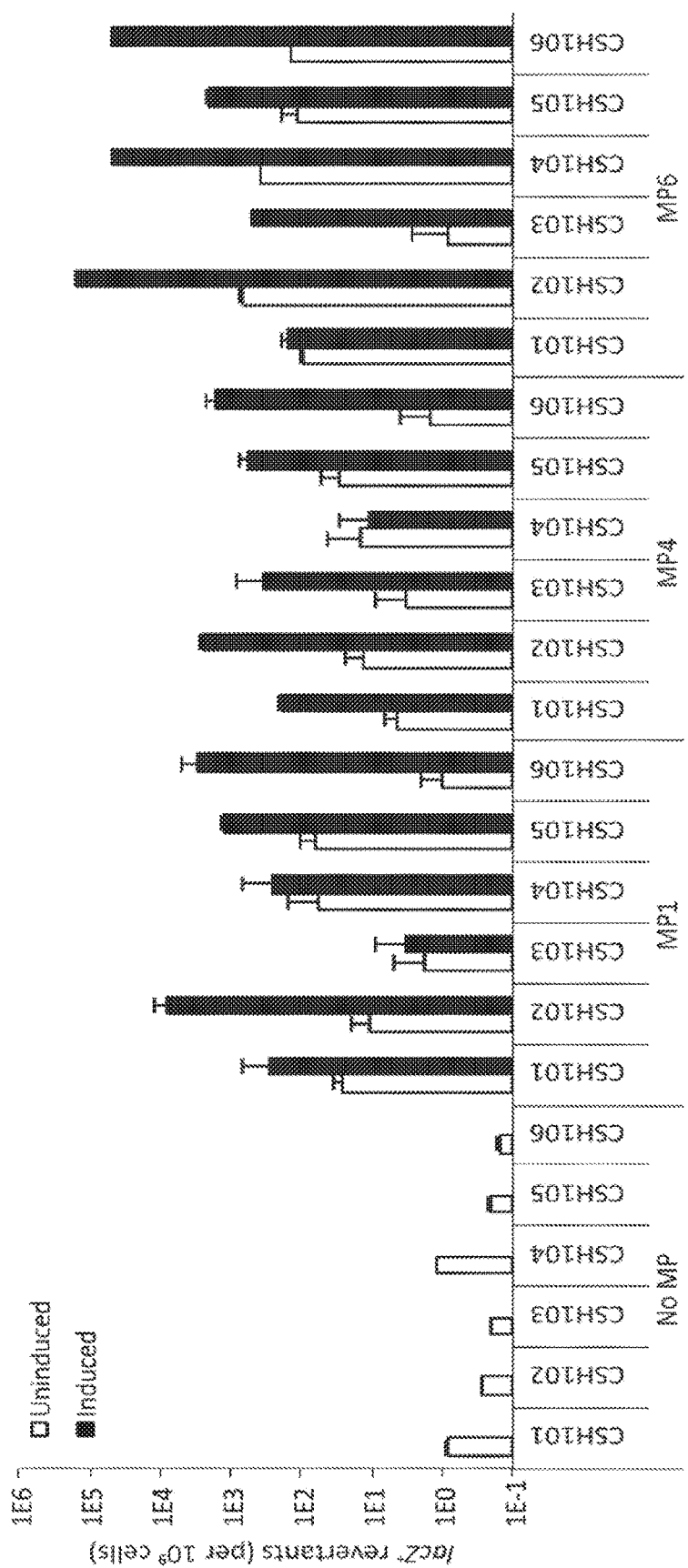
FIG. 16. Analysis of F' episomal mutations rates using various MPs. The frequency of lacZ+ revertants is the fraction of colonies surviving on lactose as the sole carbon source as compared to the total colony count (colonies that survive on glucose as sole carbon source). Each strain reports the MP's ability to increase the frequency of a specific mutation type.
Figure 17A:
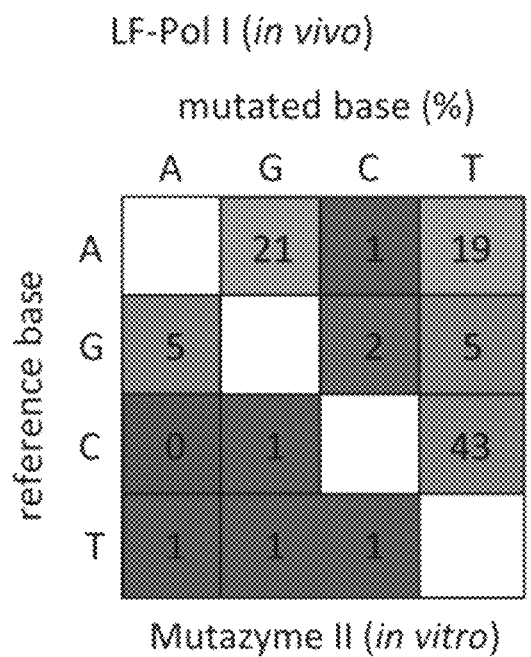
FIGS. 17A-17D. Mutagenic spectra of commonly used mutagenesis techniques. Previously reported mutagenic spectra of four commonly used mutagenesis methods are shown.
Figure 17B:
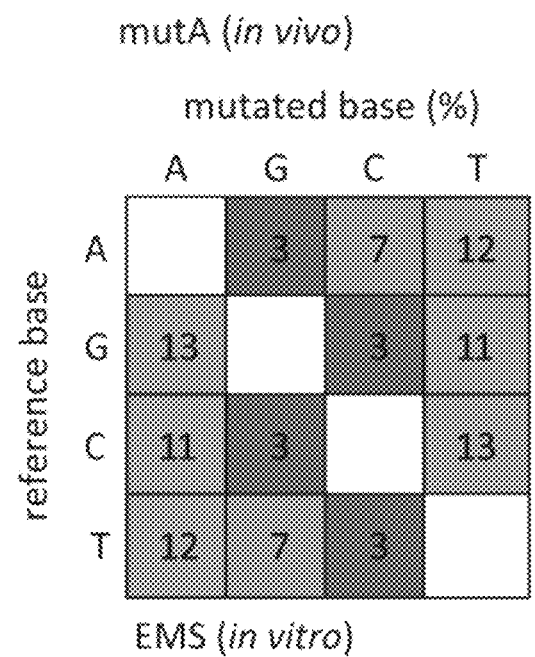
Figure 17C:
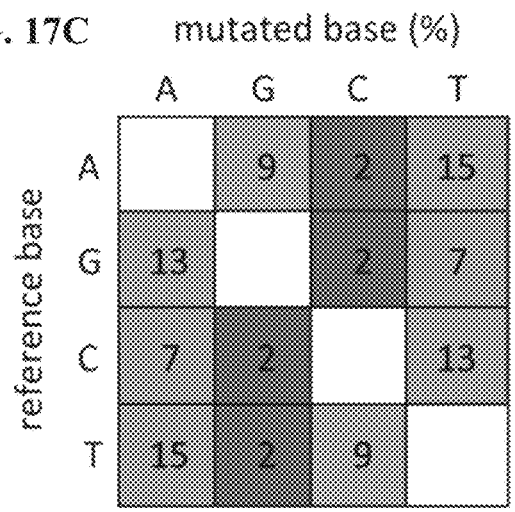
Figure 17D:
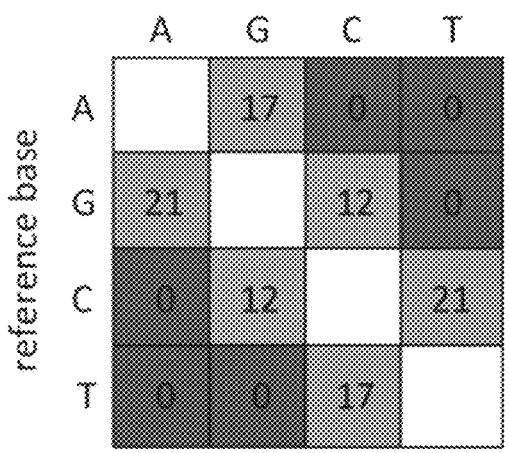

In addition to mutagenic potency, the distribution of mutation types is also important, as a narrow mutational spectrum limits the diversity of changes that can be accessed. To analyze the spectrum of produced mutations, we took advantage of previously reported distributions of rifampin-resistant rpoB mutants. Importantly, mutations covering each of the 12 possible transitions and transversions in the rpoB gene are known to endow E. coli with resistance to high levels of rifampin [29]. We assessed the spectra of MP1, MP4, and MP6 by sequencing rifampin-resistant rpoB alleles in mutated MG1655 ΔrecA::apra, and compared the spectra of each to the rpoB mutation spectrum afforded by XL1-Red (FIGS. 4A-D). MP1 yielded a narrow mutagenic spectrum strongly biased towards A:T→T:A transversions, a known side-effect of using recA730-based mutators on genomic DNA [30]. Comparatively, the intermediate MP4 had a more uniform distribution, covering more transitions and a marked increase in G:C→A:T and A:T→G:C, a hallmark of mutagenesis methods that perturb the mismatch repair response [31]. MP6 exhibited a wider spectrum still, with a more uniform distribution of transitions and transversions. The identities of the observed rifampin-resistant mutations are in agreement with previous studies (FIG. 4E) [29]. Notably, XL1-Red exclusively displayed two types of mutations, C:G→T:A and T:A→C:G transitions (FIGS. 4D, 4E). This observation is consistent with previous reports describing the narrow mutational spectrum of XL1-Red [7]. Additional MP characterization using the established β-galactosidase (lacZ) reversion strains developed by Miller and coworkers [32] revealed similar mutational spectra as observed in the rifampin resistance assays (FIG. 16).

To further characterize the mutagenic spectra, we propagated the lacZ-encoding phage SP063 using S1030 strains carrying MP1, MP4 and MP6, or transformed SP063 DNA directly into XL1-Red to produce progeny phage, and subjected the lacZ ORF from all the resultant phage to high-throughput DNA sequencing (FIGS. 4F-I). The mutagenesis efficiency for all conditions was in agreement with that revealed by the other assays (FIGS. 4A-I, 16). The MPs generated broad mutagenic spectra in progeny phage, consistent with both rpoB single clone sequencing and lacZ reversion assays, with the exception of MP1, which showed a more uniform distribution of mutation types using the phage assay and lacZ reversion assays than using rpoB sequencing. This discrepancy is likely a result of the MP1-encoded recA730 allele, which selectively enhances the rate of A:T→T:A transversions in DNA of strains lacking recA (MG1655 ΔrecA::apra), as it no longer competes for substrates with wild-type (CSH strains [32], Table 1) or reduced-activity recA mutants (S1021 and S1030, Table 1) for function. Phage sequences produced from XL1-Red revealed a much narrower mutational spectrum, with a bias for A:T→C:G mutations. Taken together, these results reveal that the MPs developed in this study can outperform the most widely used in vivo and in vitro mutagenesis techniques (FIG. 17) both in mutagenic potency and mutational breadth.

Evolution of Antibiotic Resistance Using the Designed MPs

To evaluate the impact of these MPs on laboratory evolutionary outcomes, we evolved antibiotic resistance in E. coli, as well as RNA polymerase substrate specificity changes in bacteriophage, using cells harboring different MPs. First we tested the ability of MP1, MP4, or MP6 to evolve resistance of E. coli strain MG1655 ΔrecA::apra to a number of commonly used antibiotics. Mid-log-phase cultures of MG1655 ΔrecA::apra carrying MP1, MP4, or MP6 were induced for 18-21 h, then serially diluted and plated on agar plates without antibiotics, or with 5-100 µg/mL of carbenicillin, cephotaxime, fosfomycin, kanamycin, metronidazole, norfloxacin, rifampin, spectinomycin, streptomycin, or tetracycline. The antibiotic concentrations used in all ten cases were well above known MIC values (Table 5).

TABLE 5

Minimum inhibitory concentrations (MICs) for selected antibiotics. All data regarding E. coli MICs was tabulated from the Antimicrobial Index Knowledgebase (antibiotics.toku-e.com).

| Antibiotic | MIC (ug/mL) |
| --- | --- |
| carbenicillin | 2-25 |
| cefotaxime | 0.016-0.25 |
| fosfomycin | 0.125-8 |
| kanamycin | 0.25-8 |
| metronidazole | 8-32 |

TABLE 5-continued

Minimum inhibitory concentrations (MICs) for selected antibiotics.
All data regarding *E. coli* MICs was tabulated from the
Antimicrobial Index Knowledgebase (antibiotics.toku-e.com).

| Antibiotic | MIC (ug/mL) |
|---|---|
| norfloxacin | 0.016-0.125 |
| rifampin | 0.5-16 |
| spectinomycin | 8-64 |
| streptomycin | 1-16 |
| tetracycline | 0.5-8 |

Figure 5A:
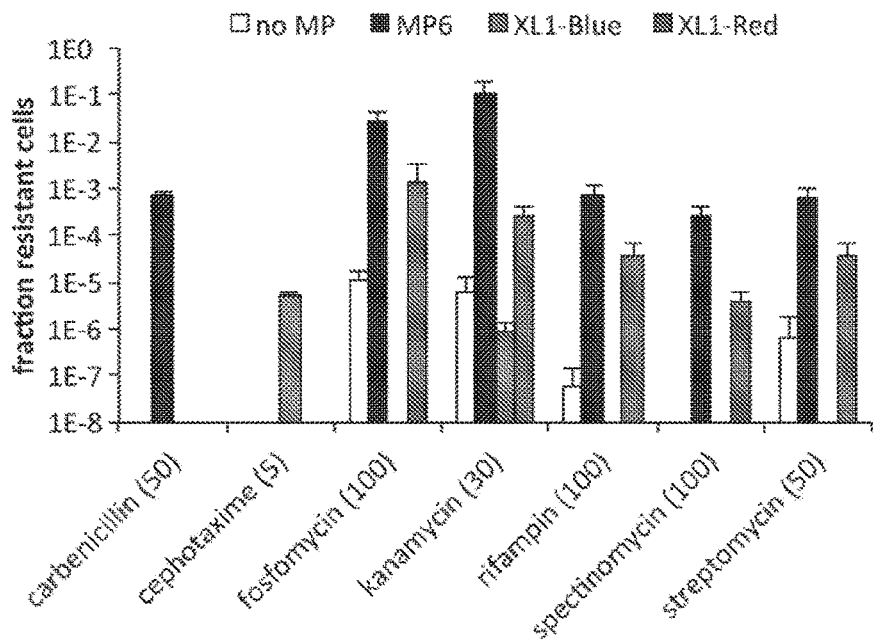
FIGS. 5A-5B. Comparison of MP6 and other mutagenesis approaches for the evolution of antibiotic resistance.

After only 18 hours of growth on antibiotic-containing solid medium, large fractions of the bacterial population showed resistance to high concentrations of carbenicillin, fosfomycin, kanamycin, metronidazole, rifampin, spectinomycin, streptomycin, and tetracycline (FIG. 5A and Table 6). No resistant colonies were detected for cefotaxime (a third-generation cephalosporin) or norfloxacin (a synthetic fluoroquinolone). The frequency of antibiotic resistance strongly correlated with MP potency (FIG. 5A). For example, we observed the evolution of resistance to high levels of kanamycin with no intermediate selection step using MP6, which allowed for up to 11% of the total population to grow in the presence of 30 μg/mL kanamycin. In contrast, only 0.02% or 0.66% of the population survived this level of kanamycin when using MP1 or MP4, respectively (FIG. 5A).

MP6 Allows for Direct RNA Polymerase Evolution During PACE

Next we compared the performance of MP1 and MP6 during phage-assisted continuous evolution (PACE) [11, 12, 33-35] of T7 RNA polymerase. We previously showed that PACE can evolve T7 RNA polymerase to recognize the distant T3 promoter ($P_{T3}$) (FIG. 18), but only using either an intermediate evolutionary stepping-stone (a T7/T3 hybrid promoter) [11, 33, 34], or an initial period of evolutionary drift in the absence of selection pressure [12]. Without either an evolutionary stepping-stone or initial evolutionary drift, PACE cannot evolve T7 RNAP variants that recognize $P_{T3}$ [11, 12, 33, 34]. We hypothesized that with improved mutagenesis, evolved solutions could be accessed before the phage population washed out without requiring evolutionary stepping-stones or modulated selection stringency.

We compared the ability of MP1 and MP6 to rapidly evolve $P_{T3}$-active T7 RNAP variants in the absence of evolutionary drift, or under conditions in which the selection stringency was slightly reduced. Importantly, previous attempts of T7 RNAP evolution towards $P_{T3}$ activity using MP1 required a drift period of virtually no selection pressure over 18 h to yield $P_{T3}$-active variants, whereas the high or intermediate selection pressures resulted in rapid phage washout [12].

In agreement with our previous results, T7 RNAP phage added to lagoons fed by host cells harboring MP1 under high or intermediate selection stringency rapidly washed out in

TABLE 6

Comparison of developed MPs to chemical mutagens, UV light and XL1-Red.

|  | CRB | CTX | FOS | KAN | MTX | RIF | SPC | STR | TET |
|---|---|---|---|---|---|---|---|---|---|
| no MP | 0.00E+00 | 0.00E+00 | 1.10E−05 | 5.78E−06 | 2.22E−07 | 5.56E−08 | 0.00E+00 | 6.67E−07 | 0.00E+00 |
| MP1 | 9.57E−06 | 0.00E+00 | 9.17E−04 | 1.84E−04 | 6.47E−01 | 1.26E−05 | 1.91E−07 | 5.68E−06 | 0.00E+00 |
| MP4 | 1.37E−05 | 0.00E+00 | 6.97E−03 | 6.56E−03 | 1.52E−06 | 6.17E−05 | 1.14E−05 | 1.56E−05 | 5.97E−06 |
| MP6 | 7.39E−04 | 0.00E+00 | 2.78E−02 | 1.11E−01 | 1.50E−04 | 7.17E−05 | 2.55E−04 | 6.22E−04 | 1.15E−04 |
| 2AP | 1.17E−07 | 2.80E−06 | 4.83E−04 | 1.53E−03 | 2.03E−05 | 1.03E−05 | 2.50E−07 | 3.17E−07 | 0.00E+00 |
| EMS | 0.00E+00 | 1.67E−07 | 3.75E−04 | 8.17E−04 | 1.10E−04 | 6.68E−05 | 0.00E+00 | 1.33E−06 | 0.00E+00 |
| MNNG | 0.00E+00 | 3.67E−07 | 1.22E−04 | 5.33E−04 | 3.22E−05 | 5.56E−06 | 3.67E−05 | 2.44E−07 | 0.00E+00 |
| UV | 0.00E+00 | 0.00E+00 | 5.00E−07 | 7.49E−06 | 0.00E+00 | 0.00E+00 | 0.00E+00 | 2.89E−08 | 0.00E+00 |
| XL1-Blue | 0.00E+00 | 5.40E−06 | 0.00E+00 | 8.66E−07 | 4.82E−01 | 0.00E+00 | 0.00E+00 | 0.00E+00 | 9.44E−01 |
| XL1-Red | 0.00E+00 | 0.00E+00 | 1.42E−03 | 2.62E−04 | 9.84E−01 | 3.62E−05 | 3.81E−06 | 3.60E−05 | 1.10E−04 |

The fraction of cells resistant to each antibiotic upon mutagenic treatment is shown for all tested antibiotics.
No resistance was observed for norfloxacin using any MP, chemical mutagen, or strain.
All MPs, chemical mutagens, and UV light treatments used *E. coli* MG1655 ΔrecA::apra.
CRB, 50 μg/mL carbenicillin; CTX, 5 μg/mL cefotaxime; FOS, 100 μg/mL fosfomycin; KAN, 30 μg/mL kanamycin, MTX, 100 μg/mL metronidazole; RIF, 100 μg/mL rifampin; SPC, 100 μg/mL spectinomycin; STR, 50 μg/mL streptomycin; TET, 10 μg/mL tetracycline.
We note that MP1 (recA730), XL1-Blue (recA1), and XL1-Red (wt recA) are all proficient at recombination, a known requirement for high-level resistance to metronidazole[61].
Additionally, XL1-Blue and XL1-Red are both inherently resistant to tetracycline, explaining the observed high incidence of resistance.

Figure 5B:
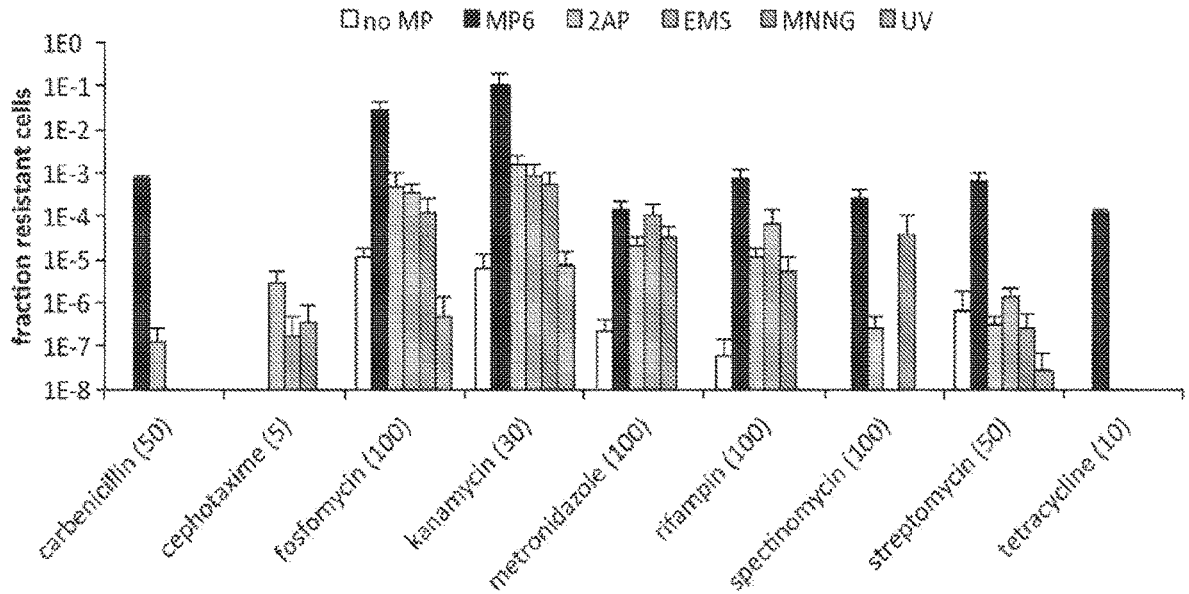

We repeated these antibiotic resistance evolution experiments to compare the performance of these MPs to those of the commonly used chemical mutagens [32] ethyl methanesulfonate (EMS), methylnitronitrosoguanidine (MNNG), and 2-aminopurine (2AP), as well as UV irradiation, XL1-Red, and XL1-Blue (FIGS. 5A, 5B: Table 6). MP6 outperformed all six of the other mutagenesis treatments or strains for all but one of the antibiotics. Cephotaxime resistance was not observed from use of any of the MPs, but was weakly detected from the chemical mutagens (FIG. 6B). We speculate that the known ability of all three of these chemical mutagens to greatly enhance G:C→A:T transitions may contribute to the evolution of cephotaxime resistance. Cumulatively, these results suggest that MP6 can rapidly generate strains with novel properties, outperforming several commonly using chemical mutagens, UV irradiation, and XL-1 Red.

Figure 6A:
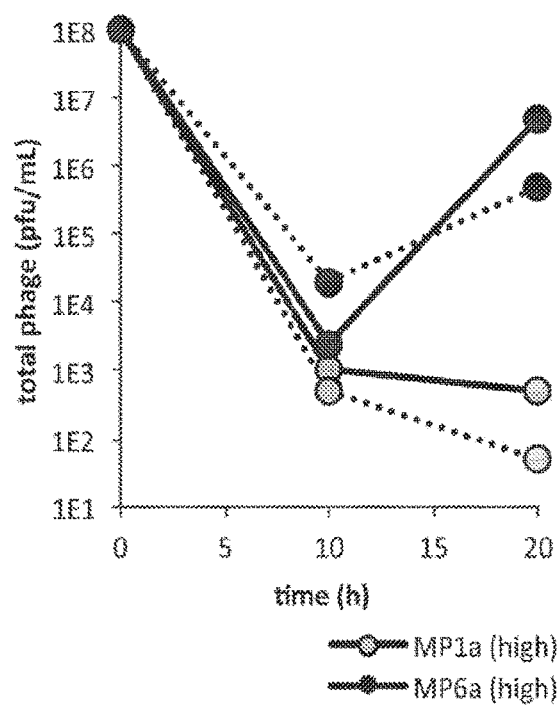
FIGS. 6A-6B. Continuous evolution of PT3-active RNAP variants. S1030 cells carrying an accessory plasmid (AP) encoding P$_{T3}$ upstream of M13 bacteriophage geneIII and either MP1a or MP6a were infected with selection phage (SP) carrying wild-type T7 RNAP under conditions in which selection stringency was high (0 ng/mL ATc) or moderate (30 ng/mL ATc).
Figure 6B:
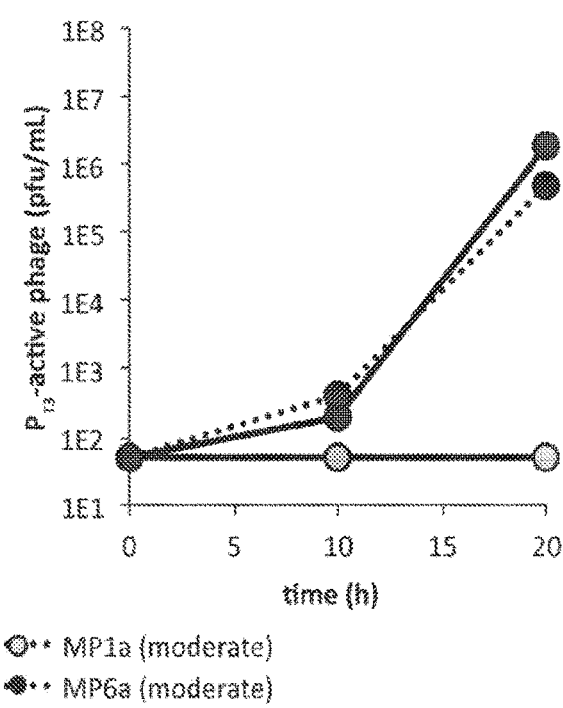
Figure 19:
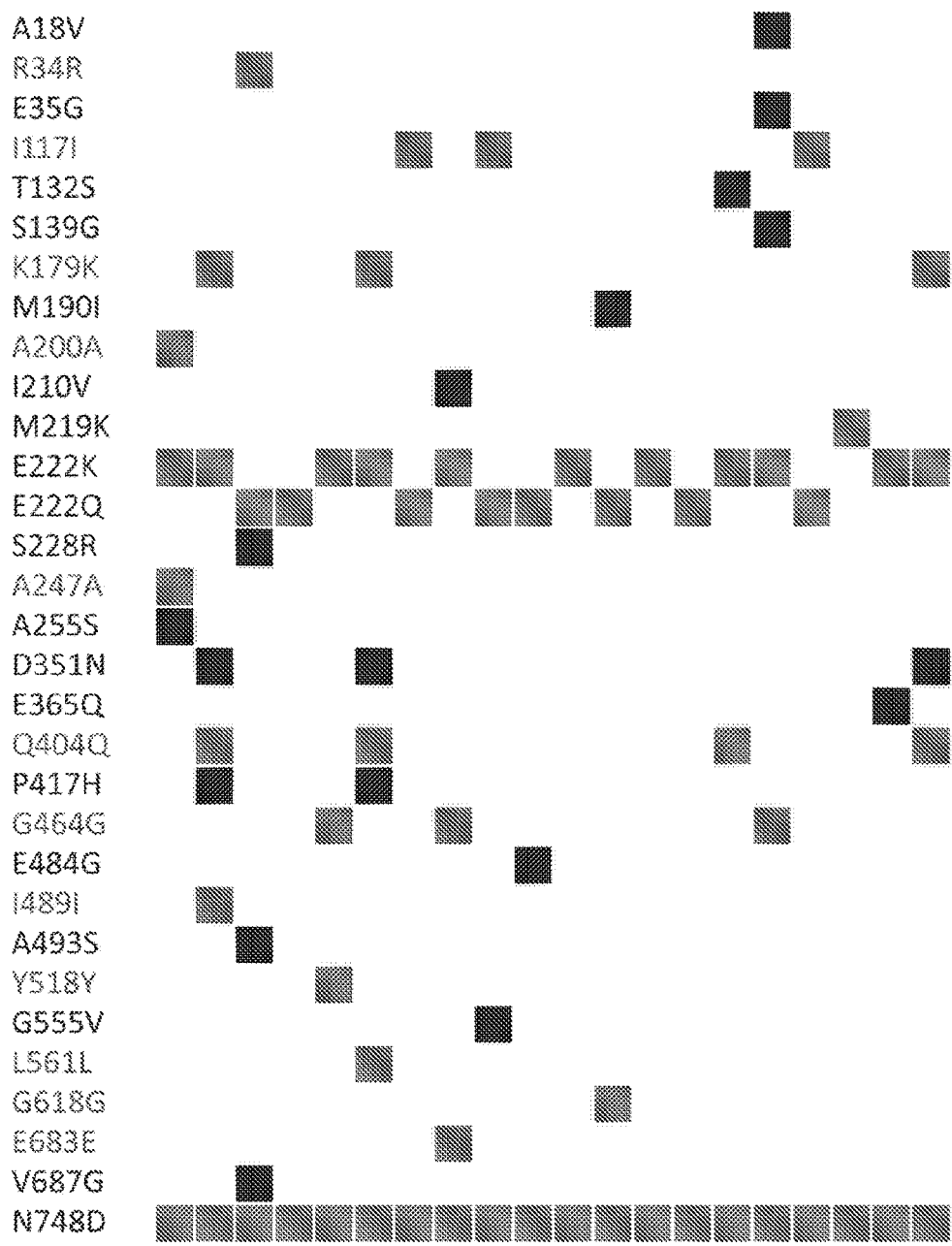
FIG. 19. Single-phage plaque sequencing of PT3-active SPs. Single phage plaques at 10 h of PACE using the $P_{T3}$ AP were isolated and subjected to Sanger sequencing. All clones carried T7 RNAP variants with conserved mutations known to confer activity on $P_{T3}$ (blue), as well as additional mutations that may further enhance activity (black). Silent mutations were also detected (red).

<20 h of PACE when required to recognize $P_{T3}$ (FIG. 6A). In contrast, both lagoons tested in which host cells harbored MP6 allowed for the propagation of T7 RNAP phage on host cells requiring $P_{T3}$ recognition under high or intermediate selection stringency, with nearly 10% of both populations after only 10 h of PACE exhibiting activity on $P_{T3}$ by activity-dependent plaque assays (FIG. 6B). Sequencing confirmed mutations M219K/E222K/E222Q together with N748D in all surviving clones (FIG. 19), in agreement with previous findings of our group and others [11, 12, 33, 34, 36]. The ability of MP6 to support the discovery of $P_{T3}$-active T7 RNAP variants highlights the ability of this MP to access mutations more efficiently, and thus mediate a more thorough and larger sampling of sequence space. Collectively, these results establish that the enhanced mutagenesis mediated by the new MPs can support accelerated access to evolved proteins that are difficult to access directly using previous methods.

DISCUSSION

Using a systematic, mechanism-guided approach, we developed a series of vectors that express a variety of genes known to adversely affect DNA replication fidelity. In total we generated and assayed 80 candidate MPs with mutation rates spanning five orders of magnitude (FIGS. 11 and 12; Tables 2 and 3). The resulting MPs support highly potent, broad-spectrum, inducible, vector-based in vivo mutagenesis that rival the performance characteristics of popular in vitro methods such as error-prone PCR, while offering key advantages of in vivo mutagenesis. These advantages include enabling mutation and selection cycles to be coupled, and bypassing transformation efficiency bottlenecks that limit the size of populations that can be generated from DNA diversified in vitro. The MPs developed here offer major advantages over current in vivo mutagenesis methods such as chemical mutagens or base analogs, UV irradiation, or constitutive hypermutator strains. Hypermutator strains, for example, generally suffer from poor transformation efficiency (XL1-Red, ~1×10$^6$ cfu/µg plasmid DNA), high instability, and narrow mutagenic spectra. MP6 increases the mutation rate of E. coli by 322,000-fold, and substantially exceeds both the mutation rate and the mutagenic spectra of XL1-Red. Importantly, MP6 can support approximately ~2.3 substitutions/kb in a gene of interest using phage vectors in a single generation, with additional increases in mutagenesis efficiency concomitant with longer propagation times.

To demonstrate the utility of these vectors, we used a whole-genome mutagenesis approach to evolve high-level antibiotic resistance in E. coli. In the absence of any prior selection or mutagenesis step, MP6 rapidly mediates the evolution of antibiotic resistance to many commonly used antibiotics within 18 h. The efficiency and effectiveness of antibiotic resistance mediated by MP6 compares favorably with that of a number of potent chemical mutagens (2AP, EMS, MNNG), UV irradiation, and the hypermutator strain XL1-Red. In addition, we observed that MP6 supports the continuous evolution of T7 RNA polymerase variants capable of initiating transcription at the non-cognate T3 promoter in less than 10 h, without requiring evolutionary stepping-stones or an initial period of evolutionary drift. The MPs provided herein are broadly applicable to the use of in vivo mutagenesis to provide efficient access to rare solutions in sequence space that would otherwise be much more difficult, or impossible, to reach using current in vitro or in vivo methods. The properties of MP6, which include very high mutagenesis efficiency, broad mutational spectrum, small-molecule inducibility, and compatibility with a variety of bacterial strains, together represent a substantial advance in in vivo mutagenesis methodology for the laboratory evolution community.

Materials and Methods

General methods. All PCR reactions were performed using PfuTurbo Cx polymerase (Agilent Technologies) or VeraSeq ULtra polymerase (Enzymatics). Water was purified using a MilliQ water purification system (Millipore, Billerica Mass.). All MPs were constructed using USER cloning (New England Biolabs). Native E. coli genes were amplified by PCR directly from genomic DNA, and non-bacterial genes were synthesized as bacterial codon-optimized gBlocks Gene Fragments (Integrated DNA Technologies). All DNA cloning was carried out using NEB Turbo cells (New England Biolabs).

General MP strain preparation. Mid log-phase (OD$_{600}$=~0.5-0.8) cells of the strain of interest grown in 2×YT (United States Biological) were transformed with the desired MP, and recovered for 45 min in Davis rich media[12] to suppress MP induction. All transformations were plated on 2×YT in 1.8% agar (United States Biological) containing 40 g/mL chloramphenicol (Sigma Aldrich), 10 µg/mL fluconazole (TCI America), 10 µg/mL amphotericin B (TCI America), 25 mM glucose (United States Biological) and grown for 12-18 h in a 37° C. incubator. Colonies transformed with the appropriate MP were picked the following day and grown in Davis rich media containing 40 µg/mL chloramphenicol, 10 g/mL fluconazole, and 10 µg/mL amphotericin B for 12-18 h. Following overnight growth of the MP-carrying strains, cultures were diluted 1,000-fold into fresh Davis rich media containing 40 µg/mL chloramphenicol, 10 µg/mL fluconazole, and 10 µg/mL amphotericin B. The remainder of each experiment is described in each of the following sections.

Rifampin resistance assay. Upon reaching mid log-phase, cultures were induced with 25 mM arabinose (Davis rich media+arabinose) or suppressed with 25 mM glucose (Davis rich media only) and allowed to continue growth for an additional ~18-24 h in a 37° C. shaker. The high arabinose concentration ensures sufficient induction of the plasmid-borne mutators MG1655 ΔrecA::apra despite arabinose catabolism by this strain upon glucose depletion. For XL1-Blue and XL1-Red strains, cultures were started directly from glycerol stocks according to the manufacturer's instructions and incubated for an identical amount of time as the MP-carrying strains. After overnight growth, cultures were serially diluted in 10-fold increments and plated on 2×YT-agar containing 10 µg/mL fluconazole, 10 g/mL amphotericin B, and 100 mM glucose+/−100 µg/mL rifampin. After 18-24 h, the number of colonies on the glucose+/− rifampin plates was counted for each culture. The mutation efficiency induced by the MP ($\mu_{bp}$, substitutions/bp/generation) was calculated using the equation: $\mu_{bp}=f/[R\times\ln(N/N_0)]$, where f is the frequency of rifampin-resistant mutants (as compared to the glucose control), R is the number of sequenced sites yielding rifampin resistance (21 sites across both rpoB clusters in our experiments), N is the final population size, and N$_0$ is the population size at which resistance is first observed (empirically determined to be ~1.5×10$^7$). To calculate $\mu_G$, $\mu_{bp}$ was multiplied by the genome size, which for MG1655 was 4.64×10$^6$ bp.

Episomal lacZ reversion assay. Upon reaching mid log-phase, the cultures were induced with 25 mM arabinose or suppressed with 25 mM glucose, and allowed to continue growth for an additional ~18-24 h. After overnight growth, the cultures were centrifuged for 2 min at 10,000× rcf and resuspended in an equal volume of 10% glycerol. This procedure was carried out twice to remove trace glucose or other carbon sources from the supernatant prior to plating. Washed cells were serially diluted in 10-fold increments using 10% glycerol and plated on M9 minimal media agar supplemented with 5 mM MgSO$_4$, 0.01% thiamine, 335 µg/mL Bluo-Gal (Life Technologies) and either 10 mg/mL glucose or 10 mg/mL lactose. The Bluo-Gal was added to ensure that survival on lactose was concomitant with lacZ reversion, and not purely due to extracellular lactose hydrolysis. After extended growth (~24-36 h), the fraction of lactose-catabolizing colonies was calculated using the number of blue colonies on the lactose plates vs. the total number of colonies on the glucose plates.

Phage lacZ inactivation assay. Upon reaching mid log-phase, the cultures were induced with 25 mM arabinose or suppressed with 25 mM glucose, allowed to grow for an additional 0-2 h, then, in the case of strain S1030, infected with SP063 phage, and allowed to grow for an additional ~18-24 h. For S1021 and XL1-Red (Agilent Technologies), SP063 DNA was miniprepped from infected S1030 cells and electroporated into these strains as they both lack F' episomes. For F⁻ cells, cultures were either induced for 2 h prior to being made electrocompetent, induced immediately following transformation, induced both prior to and following electroporation, or not induced at all. After overnight growth and phage propagation, the cultures were centrifuged 2 min at 10,000× rcf and the supernatant was filtered through a 0.2 m PVDF filter (Millipore). The supernatant was serially diluted in 10-fold increments using Davis rich media and plaqued on S1030 cells using 1.8% 2×YT-agar for the bottom layer and 0.6% 2×YT-agar supplemented with 400 µg/mL Bluo-Gal (Life Technologies) for the top layer. The fraction of white or light blue plaques (lacZ⁻ phenotype) was counted as a function of all plaques (blue+light blue+white), and used as a measure of mutation frequency for the lacZ cassette.

Sanger sequencing of rpoB mutations. Rifampin-resistant colonies were picked into 96 well plates and grown overnight in Davis rich media supplemented with 100 g/mL rifampin. Following overnight growth, 10 µL aliquots were heated at 100° C. for 10 min, followed by PCR using primers AB1678 (5'-AATGTCAAATCCGTGGCGTGAC, SEQ ID NO: 20) and AB1682 (5'-TTCACCCGGATA-CATCTCGTCTTC, SEQ ID NO: 21) to amplify an rpoB fragment containing both clusters I and II. Each fragment was sequenced twice using primers AB1680 (5'-CG-GAAGGCACCGTAAAAGACAT, SEQ ID NO: 22) and AB1683 (5'-CGTGTAGAGCGTGCGGTGAAA, SEQ ID NO: 23).

High-throughput sequencing of lacZ mutations. SP063 phage that was propagated using S1030 carrying MP1, MP4 or MP6, produced by XL1-Red following SP063 DNA electroporation, or the unmutated stock phage was amplified by PCR using primers AB437 (5'-GGCGCTGGTAAAC-CATATG, SEQ ID NO: 24) and DB213 (5'-GGAAACCGAGGAAACGCAA, SEQ ID NO: 25) to yield a ~3,400 bp fragment containing the lacZ gene. SP063 phage that was propagated under similar conditions on S1030 cells was used as the negative control. Three biological replicates were carried out for each of the aforementioned samples. The resulting PCR products were purified by gel electrophoresis using a 1% agarose gel and prepared for HTS using a Nextera kit (Illumina) and a previously described procedure[35]. Briefly, 4 µL of DNA (2.5 ng/µL), 5 µL TD buffer, and 1 µL TDE1 were mixed together and then heated to 55° C. for 5 min. After purification (Zymo DNA purification kit), the resultant "tagmented" DNA samples were amplified with Illumina-supplied primers using the manufacturer's protocol. The resulting PCR products were then purified using AMPure XP beads and the final concentration of DNA was quantified using PicoGreen (Invitrogen) and qPCR. The samples were sequenced on a MiSeq Sequencer (Illumina) in 2×300 paired-end runs using the manufacturer's reagents following the manufacturer's protocols.

High-throughput sequencing data analysis. A previously described custom MATLAB script[35] (available upon request) was used to align MiSeq reads with Q score ≤30 to the wild-type sequence and count the nucleotide positions from which the experimental sample deviates from the wild-type sequence yielding called mutations with ≥99.9% accuracy, corresponding to >3 s.d. above the mean error rate of the MiSeq high-throughput sequencing reads. To compensate for systemic sample preparation and sequencing errors, the observed fraction of mutations at each nucleotide position of the wild-type lacZ reference gene was subtracted from the fraction of mutations in a given experimental sample to result in the "corrected fraction mutated". Mutations were defined as nucleotide positions with a corrected fraction mutation that is both greater than the average corrected fraction mutated of the treatment of interest and at least one standard deviation higher than the corrected fraction mutation of the wild-type reference sequence. Duplicates belonging to set of paired-end reads were treated as a single sample, while duplicate reads of the same region with alternative adaptor/index sequences were not removed so as not to introduce bias into the sequencing analysis. This process yielded an average of ~50,000 reads per position for each of the sequenced samples.

Evolution of novel antibiotic resistance. MG1655 ΔrecA::apra cells without an MP or carrying MP1, MP4, or MP6 were grown for 18-21 hr in Davis rich media containing 40 µg/mL chloramphenicol, 10 µg/mL fluconazole, 10 µg/mL Amphotericin B, and supplemented with 200 mM arabinose to induce the MPs. Small molecule and UV mutagenesis was carried out as previously described[32]. For 2AP treatment, log-phase MG1655 ΔrecA::apra cells were diluted to ~1000 cells, the media was supplemented with 700 µg/mL 2AP (TCI America), and the culture was allowed for grow at 37° C. for an additional 18-21 hr. For EMS treatment, 2 mL of a log-phase MG1655 ΔrecA::apra culture (~1×10⁸-1×10⁹ cells) was centrifuged, washed twice with 1 mL A buffer on ice, then supplemented with 14 µL EMS (TCI America). Cells were lightly vortexed, and allowed to shake at 200 rpm at 37° C. for 45 min. After this time, the culture was centrifuged, washed twice with 1 mL A buffer on ice, diluted by 20-fold into Davis rich media without antibiotics, and allowed to grow for 18-21 hr. For MNNG treatment, 2 mL of a log-phase MG1655 ΔrecA::apra culture (~1×10⁸-1×10⁹ cells) was centrifuged, washed twice with 1 mL citrate buffer (pH 5.5) on ice, supplemented with 111 µL of 1 mg/mL MNNG (TCI America) and placed in a 37° C. water bath for 30 min. Following treatment, the cells were centrifuged, washed twice with 1 mL 0.1 M potassium phosphate buffer (pH 7.0), diluted by 4-fold into Davis rich media without antibiotics, and allowed to grow for 18-21 hr. For UV irradiation, 2 mL of a log-phase MG1655 ΔrecA::apra culture (~1×10⁸-1×10⁹ cells) was centrifuged, resuspended in 1 mL 0.1 M MgSO4 and placed on ice for 10 min. Cells were placed in a petri dish and exposed to UV light from a SM-36-2GR UV lamp (American Air & Water) for 1 min, uncovered, at a distance of ~10 cm. Immediately following UV exposure, cells were diluted by 20-fold into Davis rich media without antibiotics, and allowed to grow for 18-21 hr. For XL1-Blue and XL1-Red strains, cultures were started directly from glycerol stocks according to the manufacturer's instructions and allowed to grow for 18-21 hr in Davis rich media. Following overnight growth, all cultures were serially diluted in Davis rich media and plated on 2×YT-agar containing 10 µg/mL fluconazole, 10 µg/mL amphotericin B, and 100 mM glucose+/−the appropriate antibiotic. After overnight growth (~18-24 h), the numbers of colonies on the glucose+/−antibiotics plates were counted.

Continuous evolution of PT3-active T7 RNAP variants. Two modified versions of MP1 and MP6 (MP1a and MP6a, respectively) were generated to support robust phage propagation during PACE. These MPs carry all of the components of their respective MPs, in addition to the previously described anhydrotetracycline (ATc)-dependent drift promoter driving geneIII[12]. S1030 strains carrying either MP in addition to the $P_{T3}$ accessory plasmid (AP) were inoculated into host-cell cultures (chemostats) and grown at a dilution rate of 1.6 vol/hr as previously described[12]. Lagoons flowing from the respective chemostats were maintained at 40 mL, diluted at 0.75 vol/hr, and supplemented with either 25 mM arabinose only (high stringency) or 25 mM arabinose with 30 ng/mL ATc (intermediate stringency) for 8 h prior to infection with packaged T7 RNAP SP. We note that concentrations exceeding 30 ng/mL for extended timeframes during PACE (>24 hr) result in excision of the evolving gene from the selection phage. As continuous flow conditions effectively enrich for SPs capable of rapid replication, selection phage with smaller genomes are rapidly enriched to totally dominate the evolving pool. Each lagoon was infected with 4×10$^9$ pfu, resulting in an initial titer of 10$^8$ pfu/mL of the lagoon. Samples were taken 10 h and 20 h after infection, centrifuged at 10,000 rcf for 2 min, then sterile filtered with a 0.2 µm filter and stored overnight at 4° C. Phage aliquots were titered on S1030 cells carrying either the PSP-geneIII AP (total phage) or the $P_{T3}$-geneIII AP ($P_{T3}$-active phage).

MP6 optimization. We retained native bacterial ribosome-binding sites (RBSs) upstream of the ORFs for four of the six MP6 genes. The exceptions are dam, which natively lacks a canonical RBS in the *E. coli* genome, and cda1, which derives from the eukaryote *P. marinus* and thus does not use a bacterial Shine-Dalgarno sequence. In an attempt to further enhance mutational potency by modulating the expression of dnaQ926, dam, seqA, emrR, ugi, and cda1, we varied RBS upstream of each of these six genes by individually mutating them to fully complement the 16S rRNA, and resulting in optimal transcript translation. Interestingly, strengthening the RBSs upstream of each of the six genes generally reduced the potency of the MP, with the exception of the seqA and dnaQ926 RBSs (Tables 2 and 3). Strengthening the seqA RBS proved highly lethal under induced conditions, likely as a consequence of impeded genomic replication (Tables 2 and 3). Increasing the strength of the dnaQ926 RBS enhanced the mutagenic potency of the MP by 4-fold under induced conditions, concomitant with a minor increase in background mutagenesis, but was more toxic to bacteria as evidenced by a greater loss of viability under induced conditions (Tables 2 and 3). Additionally, measurement of the mutation rate of the resulting MP became irreproducible, consistent with MP instability under these conditions. These findings together suggest that additional mutagenic potency gains beyond that of MP6 may result in error catastrophe and reduced MP stability.

Figure 18:
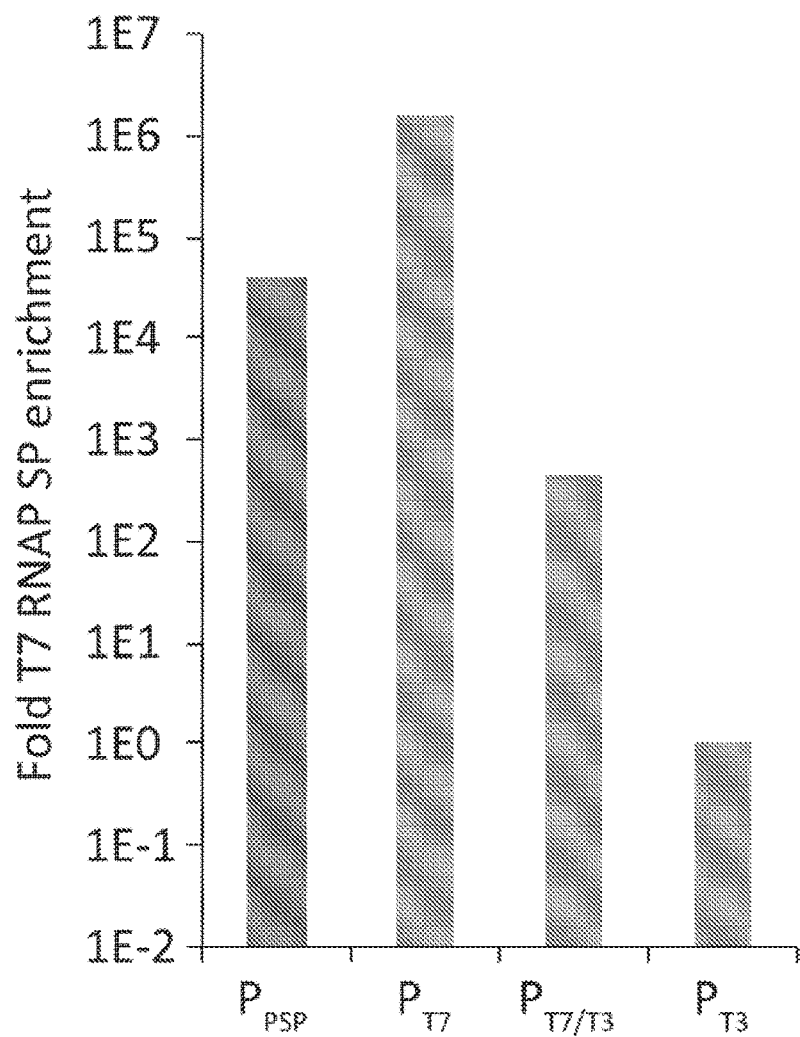
FIG. 18. Activity of T7 RNAP on cognate and non-cognate promoters. Log-phase S1030 cells carrying accessory plasmids (APs) with a geneIII cassette with an upstream phage shock protein (PSP), T7, hybrid T7/T3, or T3 promoter were infected with selection phage (SPs) carrying the wild-type T7 RNAP. The fraction of output phage vs. input phage indirectly reports on the activity of the T7 RNAP on the various promoters. Enrichment factors of ~100 or less indicate extremely weak to non-existent activity.

LacZ reversion analysis. Strains CSH101 to CSH106 each carry different nonfunctional missense mutants of lacZ at codon 461 (natively encoding glutamic acid) on the F' episome. If a mutation reverts the nonfunctional codon to a glutamic acid, the strain can synthesize functional LacZ and survives using lactose as the only carbon source. These six strains are designed to report on all 12 possible mutations using this codon reversion. Using these strains, we observed that MP1 had the most narrow episomal mutational spectrum, with a moderate bias towards G:C→A:T (CSH102) and A:T→G:C (CSH106) substitutions (FIG. 17). MP4 showed an improved distribution of mutations, with a still moderate preference for A:T→G:C (CSH106) substitutions (FIG. 18). MP6 showed a near equal distribution of mutations in all six strains, with the exception of A:T→C:G (CSH101) substitutions which were detected at 10- to 100-fold lower levels than the other substitutions (FIG. 16). Taken together, these results suggest that MP6 generally outperforms the other MPs and XL1-Red based on both the frequency of lacZ reversion as well as the breadth of mutation types detected by these strains. Importantly, the mutational potency and spectra using the episomal lacZ reversion assays were in agreement with those from the rifampin resistance assays (FIGS. 4A-E, 17). These results establish the ability of the MPs to affect a wide variety of mutations in both genomic and episomal DNA.

Exemplary Mutagenesis Plasmid Sequence

The Sequence for an exemplary, non-limiting embodiment of a mutagenesis expression construct as provided herein, in this case a mutagenesis plasmid comprising a nucleic acid sequence encoding dnaQ926, dam, seqA, emrR, ugi, and CDA1 is provided below:

| | |
|---|---|
| pAB086p10 - MP CloDF13 pBAD dnaQ926 dam seqA emrR ugi CDA1 cat standard; circular DNA; 6681 BP. | |
| LOCUS pJC184 6537 bp DNA circular | |
| Key | Location/Qualifiers |
| terminator | 867..911 |
| | /note="rrnB1 transcriptional terminator" |
| rep_origin | complement (39..777) |
| | /dnas_title="cloDF13" |
| | /vntifkey="33" |
| | /label=cloDF13 |
| terminator | complement (5859..5894) |
| | /note="P14/tonB bidirectional terminator" |
| | /note="termination of cat transcript is slightly weaker than in opposite direction" |
| CDS | complement (5908..6567) |
| | /note="cat (CmR)" |
| | /note="from pACYCDuet-1" |
| modified_base | 5983..5983 |
| | /note="mutation" |
| | /note="annotated as a G in pACYCDuet cat marker annotation, here it is an A, this mutation is silent from codon GTC (Val, 25% codon usage) to GTT (Val, 21% usage)" | pAB086p10 - MP CloDF13 pBAD dnaQ926 dam seqA emrR ugi CDA1 cat standard; circular DNA; 6681 BP.
LOCUS    pJC184    6537 bp    DNA    circular
Key              Location/Qualifiers

| | |
|---|---|
| promoter | 6568..6665 |
| | /note="cat promoter" |
| | /note="from pACYCDuet-1" |
| CDS | complement (927..1805) |
| | /dnas_title="araC" |
| | /vntifkey="4" |
| | /label=araC |
| misc_feature | 1903..1903 |
| | /dnas_title="C to A ***" |
| | /vntifkey="21" |
| | /label=C to A *** |
| misc_feature | 1821..1821 |
| | /dnas_title="A to G ***" |
| | /vntifkey="21" |
| | /label=A to G *** |
| prim_transcript | complement (1969..1969) |
| | /note="pC TSS" |
| protein_bind | 1992..2008 |
| | /note="araO1" |
| protein_bind | 1971..1987 |
| | /note="araO1" |
| protein_bind | 1834..1850 |
| | /note="araO2" |
| protein_bind | 2013..2034 |
| | /note="CAP" |
| misc_feature | 2093..2093 |
| | /note="" |
| misc_feature | 2079..2079 |
| | /note="" |
| prim_transcript | 2117..2117 |
| | /note="pBAD TSS" |
| protein_bind | 2045..2061 |
| | /note="araI1" |
| protein_bind | 2066..2082 |
| | /note="araI2" |
| −10_signal | 2103..2108 |
| | /note="−10" |
| −35_signal | 2079..2084 |
| | /note="−35" |
| promoter | 2013..2165 |
| | /dnas_title="pBAD" |
| | /vntifkey="30" |
| | /label=pBAD |
| CDS | 2166..2897 |
| | /dnas_title="dnaQ926" |
| | /vntifkey="4" |
| | /label=dnaQ926 |
| conflict | 2199..2201 |
| | /note="D12A" |
| conflict | 2205..2207 |
| | /note="E14A" |
| RBS | 2156..2165 |
| | /note=">sd5 RBS" |
| RBS | 2907..2925 |
| | /note="Modified mutS RBS" |
| CDS | 2926..3762 |
| | /note="dam (wt)" |
| CDS | 3791..4336 |
| | /note="seqA (wt)" |
| RBS | 3771..3790 |
| | /note="seqA Native RBS" |
| CDS | 4365..4895 |
| | /note="emrR (wt)" |
| RBS | 4345..4364 |
| | /note="native emrR RBS" |
| CDS | 4924..5178 |
| | /note="PBS2 UGI" |
| RBS | 4903..4923 |
| | /note="Native UGI RBS" |
| RBS | 5187..5207 |
| | /note="dnaE RBS" |
| CDS | 5208..5834 |
| | /note="pmCDA1 (opt)" |
| −10_signal | complement (734..739) | pAB086p10 - MP CloDF13 pBAD dnaQ926 dam seqA emrR ugi CDA1 cat standard; circular DNA; 6681 BP.
LOCUS  pJC184  6537 bp  DNA  circular
Key           Location/Qualifiers

|  |  |
|---|---|
|  | /note="−10" |
| −35_signal | complement (757..762) |
|  | /note="−35" |
| −10_signal | 606..611 |
|  | /note="−10" |
| −35_signal | 582..587 |
|  | /note="−35" |
| promoter | complement (729..768) |
|  | /note="RNA II Promoter (0.93)" |
| promoter | 576..615 |
|  | /note="RNA I Promoter (0.95)" |
| misc_RNA | 618..722 |
|  | /note="RNA I" |
| misc_RNA | complement (39..725) |
|  | /note="RNA II" |

```
                                                      (SEQ ID NO: 26)
cactcggtcg ctacgctccg ggcgtgagac tgcggcgggc gctgcggaca catacaaagt    60
tacccacaga ttccgtggat aagcagggga ctaacatgtg aggcaaaaca gcagggccgc   120
gccggtggcg tttttccata ggctccgccc tcctgccaga gttcacataa acagacgctt   180
ttccggtgca tctgtgggag ccgtgaggct caaccatgaa tctgacagta cgggcgaaac   240
ccgacaggac ttaaagatcc ccaccgtttc cggcgggtcg ctccctcttg cgctctcctg   300
ttccgaccct gccgtttacc ggatacctgt tccgcctttc tcccttacgg gaagtgtggc   360
gctttctcat agctcacaca ctggtatctc ggctcggtgt aggtcgttcg ctccaagctg   420
ggctgtaagc aagaactccc cgttcagccc gactgctgcg ccttatccgg taactgttca   480
cttgagtcca acccggaaaa gcacggtaaa acgccactgg cagcagccat tggtaactgg   540
gagttcgcag aggatttgtt tagctaaaca cgcggttgct cttgaagtgt gcgccaaagt   600
ccggctacac tggaaggaca gatttggttg ctgtgctctg cgaaagccag ttaccacggt   660
taagcagttc cccaactgac ttaaccttcg atcaaaccac ctccccaggt ggttttttcg   720
tttacagggc aaaagattac gcgcagaaaa aaggatctca agaagatcc  tttgatcttt   780 tctactgaac cgctctagat ttcagtgcaa tttatctctt caaatgtagc acctgaagtc   840
agcccaggag gaagaggaca tccggtcaaa taaaacgaaa ggctcagtcg aaagactggg   900
cctttcgttt tagacttagg gaccctttat gacaacttga cggctacatc attcactttt   960
tcttcacaac cggcacggaa ctcgctcggg ctggccccgg tgcatttttt aaatacccgc  1020
gagaaataga gttgatcgtc aaaaccaaca ttgcgaccga cggtggcgat aggcatccgg  1080
gtggtgctca aaagcagctt cgcctggctg atacgttggt cctcgcgcca gcttaagacg  1140
ctaatcccta actgctggcg gaaaagatgt gacagacgcg acggcgacaa gcaaacatgc  1200
tgtgcgacgc tggcgatatc aaaattgctg tctgccaggt gatcgctgat gtactgacaa  1260
gcctcgcgta cccgattatc catcggtgga tggagcgact cgttaatcgc ttccatgcgc  1320
cgcagtaaca attgctcaag cagatttatc gccagcagct ccgaatagcg cccttcccct  1380
tgcccggcgt taatgatttg cccaaacagg tcgctgaaat gcggctggtg cgcttcatcc  1440
gggcgaaaga accccgtatt ggcaaatatt gacggccagt taagccattc atgccagtag  1500
gcgcgcggac gaaagtaaac ccactggtga taccattcgc gagcctccgg atgacgaccg  1560
tagtgatgaa tctctcctgg cgggaacagc aaaatatcac ccggtcggca aacaaattct  1620
```

```
cgtccctgat ttttcaccac cccctgaccg cgaatggtga gattgagaat ataacctttc    1680
attcccagcg gtcggtcgat aaaaaaatcg agataaccgt tggcctcaat cggcgttaaa    1740
cccgccacca gatgggcatt aaacgagtat cccggcagca ggggatcatt ttgcgcttca    1800
gccatacttt tcatactccc accattcaga gaagaaacca attgtccata ttgcatcaga    1860
cattgccgtc actgcgtctt ttactggctc ttctcgctaa cccaaccggt aaccccgctt    1920
attaaaagca ttctgtaaca aagcgggacc aaagccatga caaaaacgcg taacaaaagt    1980
gtctataatc acggcagaaa agtccacatt gattatttgc acggcgtcac actttgctat    2040
gccatagcat ttttatccat aagattagcg gatcctacct gacgcttttt atcgcaactc    2100
tctactgttt ctccataccc gttttttttgg acgcgtacaa ctcaagtctg acataAAtGA    2160
ccgctatgag cactgcaatt acacgccaga tcgttctcGC TaccGCAacc accggtatga    2220
accagattgg tgcgcactat gaaggccaca agatcattga gattggtgcc gttgaagtgg    2280
tgaaccgtcg cctgacgggc aataacttcc atgtttatct caaacccgat cggctggtgg    2340
atccggaagc ctttggcgta catggtattg ccgatgaatt tttgctcgat aagcccacgt    2400
ttgccgaagt agccgatgag ttcatggact atattcgcgg cgcggagttg gtgatccata    2460
acgcagcgtt cgatatcggc tttatggact acgagttttc gttgcttaag cgcgatattc    2520
cgaagaccaa tactttctgt aaggtcaccg atagccttgc ggtggcgagg aaaatgtttc    2580
ccggtaagcg caacagcctc gatgcgttat gtgctcgcta cgaaatagat aacagtaaac    2640
gaacgctgca cggggcatta ctcgatgccc agatccttgc ggaagtttat ctggcgatga    2700
ccggtggtca aacgtcgatg gcttttgcga tggaaggaga gacacaacag caacaaggtg    2760
aagcaacaat tcagcgcatt gtacgtcagg caagtaagtt acgcgttgtt tttgcgacag    2820
atgaagagat tgcagctcat gaagcccgtc tcgatctggt gcagaagaaa ggcggaagtt    2880
gcctctggcg agcataattt aatatcagta aaccggacat aacccatgaa gaaaaatcgc    2940
gcttttttga agtgggcagg gggcaagtat cccctgcttg atgatattaa acggcatttg    3000
cccaagggcg aatgtctggt tgagccttttt gtaggtgccg ggtcggtgtt tctcaacacc    3060
gacttttctc gttatatcct tgccgatatc aatagcgacc tgatcagtct ctataacatt    3120
gtgaagatgc gtactgatga gtacgtacag gccgcacgcg agctgtttgt tcccgaaaca    3180
aattgcgccg aggtttacta tcagttccgc gaagagttca acaaaagcca ggatccgttc    3240
cgtcgggcgg tactgttttt atatttgaac cgctacggtt acaacggcct gtgtcgttac    3300
aatctgcgcg gtgagtttaa cgtgccgttc ggccgctaca aaaaacccta tttcccggaa    3360
gcagagttgt atcacttcgc tgaaaaagcg cagaatgcct ttttctattg tgagtcttac    3420
gccgatagca tggcgcgcgc agatgatgca tccgtcgtct attgcgatcc gccttatgca    3480
ccgctgtctg cgaccgccaa ctttacggcg tatcacacaa acagtttttac gcttgaacaa    3540 caagcgcatc tggcggagat cgccgaaggt ctggttgagc gccatattcc agtgctgatc    3600
tccaatcacg atacgatgtt aacgcgtgag tggtatcagc gcgcaaaatt gcatgtcgtc    3660
aaagttcgac gcagtataag cagcaacggc ggcacacgta aaaaggtgga cgaactgctg    3720
gctttgtaca aaccaggagt cgtttcaccc gcgaaaaaat aattcagcta agacactgca    3780
ctggattaag atgaaaacga ttgaagttga tgatgaactc tacagctata ttgccagcca    3840
cactaagcat atcggcgaga gcgcatccga cattttacgg cgtatgttga aattttccgc    3900
cgcatcacag cctgctgctc cggtgacgaa agaggttcgc gttgcgtcac ctgctatcgt    3960
cgaagcgaag ccggtcaaaa cgattaaaga caaggttcgc gcaatgcgtg aacttctgct    4020
ttcggatgaa tacgcagagc aaaagcgagc ggtcaatcgc tttatgctgc tgttgtctac    4080
```

```
actatattct cttgacgccc aggcgtttgc cgaagcaacg gaatcgttgc acggtcgtac      4140
acgcgtttac tttgcggcag atgaacaaac gctgctgaaa atggtaatc agaccaagcc       4200
gaaacatgtg ccaggcacgc cgtattgggt gatcaccaac accaacaccg gccgtaaatg      4260
cagcatgatc gaacacatca tgcagtcgat gcaattcccg gcggaattga ttgagaaggt      4320
ttgcggaact atctaacggc tgaaattaat gaggtcatac ccaaatggat agttcgttta     4380
cgcccattga acaaatgcta aaatttcgcg ccagccgcca cgaagatttt ccttatcagg     4440
agatccttct gactcgtctt tgcatgcaca tgcaaagcaa gctgctggag aaccgcaata    4500
aaatgctgaa ggctcagggA attaacgaga cgttgtttat ggcgttgatt acgctggagt   4560
ctcaggaaaa ccacagtatt cagccttctg aattaagttg tgctcttgga tcatcccgta   4620
ccaacgcgac gcgtattgcc gatgaactgg aaaaacgcgg ttggatcgaa cgtcgtgaaa   4680
gcgataacga tcgccgctgc ctgcatctgc aattaacgga aaaggtcac gagttttgc      4740
gcgaggtttt accaccgcag cataactgcc tgcatcaact ctggtccgcg ctcagcacaa   4800
cagaaaaaga tcagctcgag caaatcaccc gcaaattgct ctcccgtctc gaccagatgg   4860
aacaagacgg tgtggttctc gaagcgatga gctaataata caaaaattag gaggaatttc   4920
aacatgacaa atttatctga catcattgaa aagaaacag gaaaacaact agtgattcaa      4980
gaatcaattc taatgttacc agaagaagta gaggaagtaa ttgggaataa accagaaagt    5040
gatattttag ttcatactgc ttatgatgaa agtacagatg aaaatgtaat gctattaact    5100
tcagatgctc cagaatataa accttgggct ttagtaattc aagacagtaa tggagaaaat   5160
aaaattaaaa tgttataagt cgagattaag taaaccggaa tctgaagatg accgacgcgg   5220
aatacgttcg tatccacgaa aaactggaca tctacaacctt caaaaaacag ttcttcaaca   5280
acaaaaaatc tgtttctcac cgttgctacg ttctgttcga actgaaacgt cgtggtgaac   5340
gtcgtgcgtg cttctggggt tacgcggtta acaaacagca gtctggtacc gaacgtggta   5400
tccacgcgga aatcttctct atccgtaaag ttgaagaata cctgcgtgac aacccgggtc   5460
agttcaccat caactggtac tcttcttggt ctccgtgcgc ggactgcgcg gaaaaaatcc   5520
tggaatggta caaccaggaa ctgcgtggta acggtcacac cctgaaaatc tgggcgtgca   5580
aactgtacta cgaaaaaaac gcgcgtaacc agatcggtct gtggaacctg cgtgacaacg   5640
gtgttggtct gaacgttatg gtttctgaac actaccagtg ctgccgtaaa atcttcatcc   5700
agtcttctca caaccagctg aacgaaaacc gttggctgga aaaaccctg aaacgtgcgg   5760
aaaaacgtcg ttctgaactg tctatcatga tccaggttaa aatcctgcac accaccaaat   5820
ctccggcggt ttaaacttaa ttaacggcac tcctcagcca agtcaaaagc ctccgGTcgg   5880
aggcttttga ctacatgccc atggcgttta cgccccgccc tgccactcat cgcagtactg   5940
ttgtaattca ttaagcattc tgccgacatg gaagccatca caacggcat gatgaacctg    6000
aatcgccagc ggcatcagca ccttgtcgcc ttgcgtataa tatttgccca tagtgaaaac   6060
gggggcgaag aagttgtcca tattggccac gtttaaatca aaactggtga aactcaccca   6120
gggattggct gagacgaaaa acatattctc aataaaccct ttagggaaat aggccaggtt   6180
ttcaccgtaa cacgccacat cttgcgaata tatgtgtaga aactgccgga aatcgtcgtg   6240
gtattcactc cagagcgatg aaaacgtttc agtttgctca tggaaaacgg tgtaacaagg   6300
gtgaacacta tcccatatca ccagctcacc gtctttcatt gccatacgga actccggatg   6360
agcattcatc aggcgggcaa gaatgtgaat aaaggccgga taaaacttgt gcttattttt   6420
ctttacggtc tttaaaaagg ccgtaatatc cagctgaacg gtctggttat aggtacattg   6480
```

```
agTaactgac tgaaatgcct caaaatgttc tttacgatgc cattgggata tatcaacggt        6540
ggtatatcca gtgatttttt tctccatttt agcttcctta gctcctgaaa atctcgataa        6600
ctcaaaaaat acgccggta gtgatcttat ttcattatgg tgaaagttgg aacctcttac         6660
gtgccaAgcc aaataggccg t                                                   6690
```

Exemplary Drift Plasmid Sequences

Figure 26:
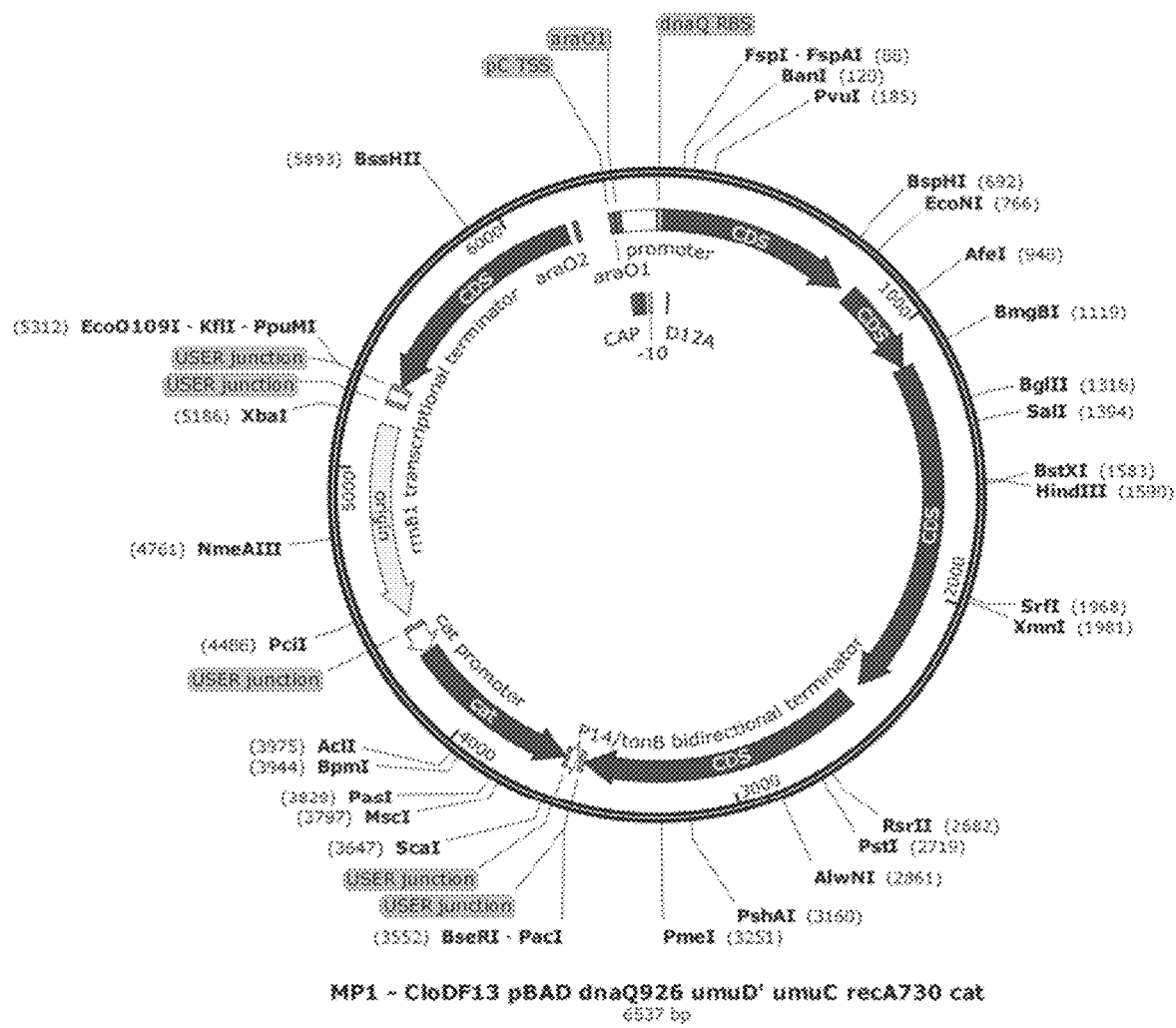
FIG. 26. MP1 Vector Map. A schematic depiction of one embodiment of a MP1 mutagenesis vector is provided, referenced herein as SEQ ID NO: 43. This embodiment comprises dnaQ926, umuD', umuC, and recA730.
Figure 27:
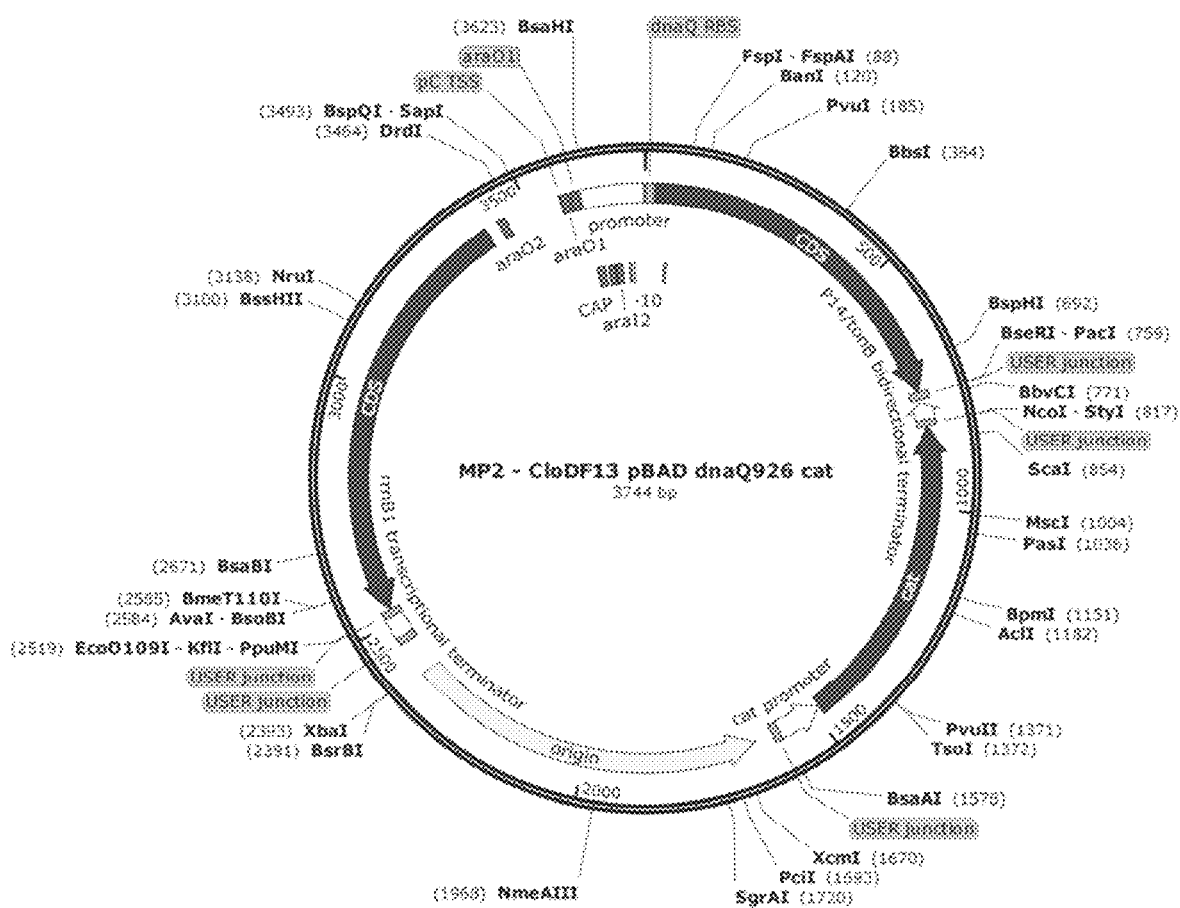
FIG. 27. MP2 Vector Map. A schematic depiction of one embodiment of a MP2 mutagenesis vector is provided, referenced herein as SEQ ID NO: 44. This embodiment comprises dnaQ926.
Figure 28:
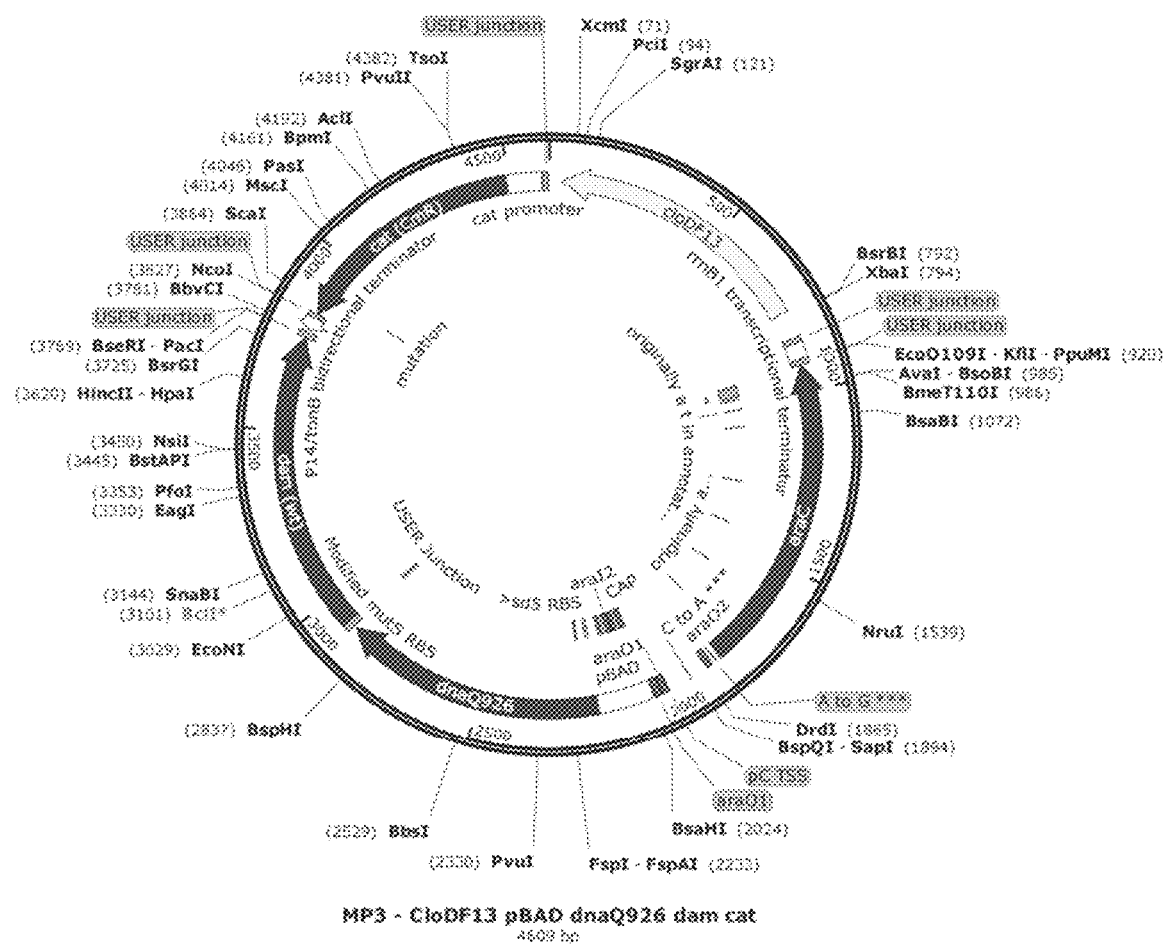
FIG. 28. MP3 Vector Map. A schematic depiction of one embodiment of a MP3 mutagenesis vector is provided, referenced herein as SEQ ID NO: 45. This embodiment comprises araC, dnaQ926, and dam.
Figure 29:
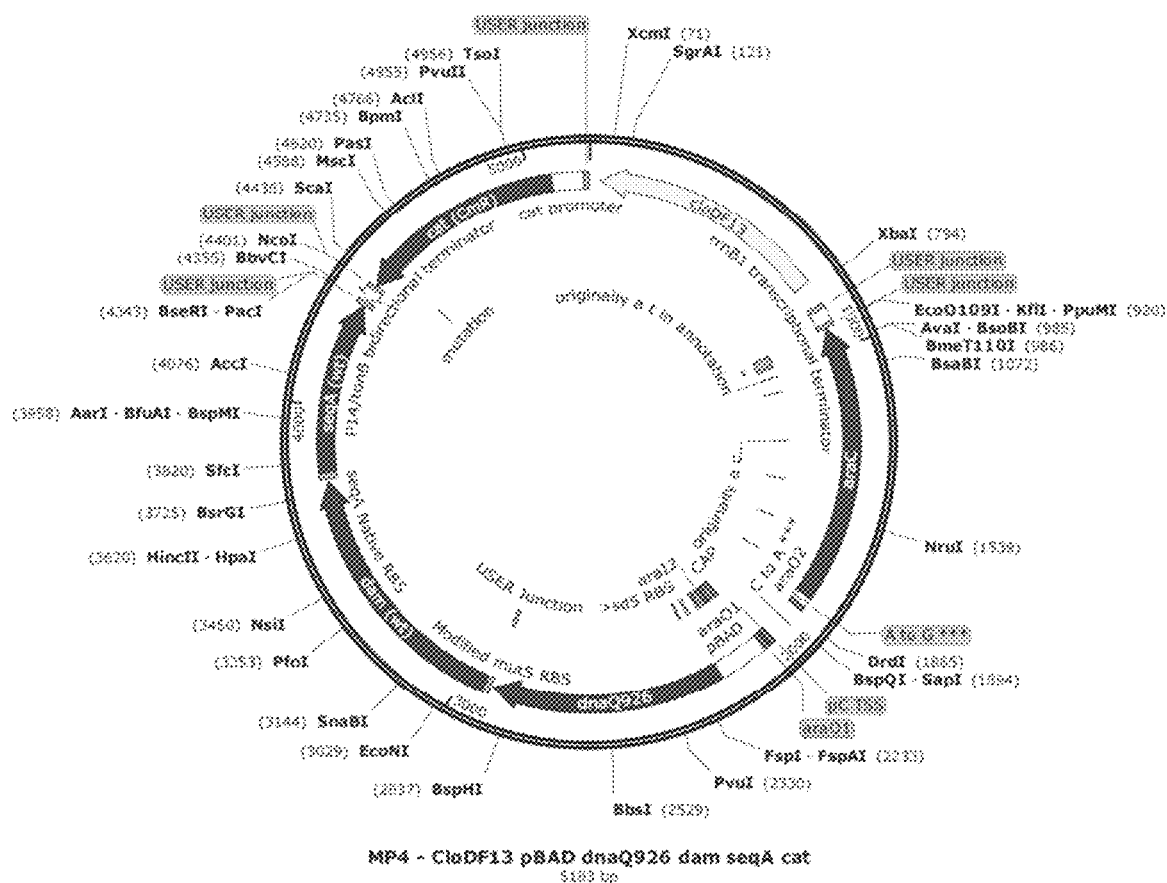
FIG. 29. MP4 Vector Map. A schematic depiction of one embodiment of a MP4 mutagenesis vector is provided, referenced herein as SEQ ID NO: 46. This embodiment comprises araC, dnaQ926, dam, and seqA.
Figure 30:
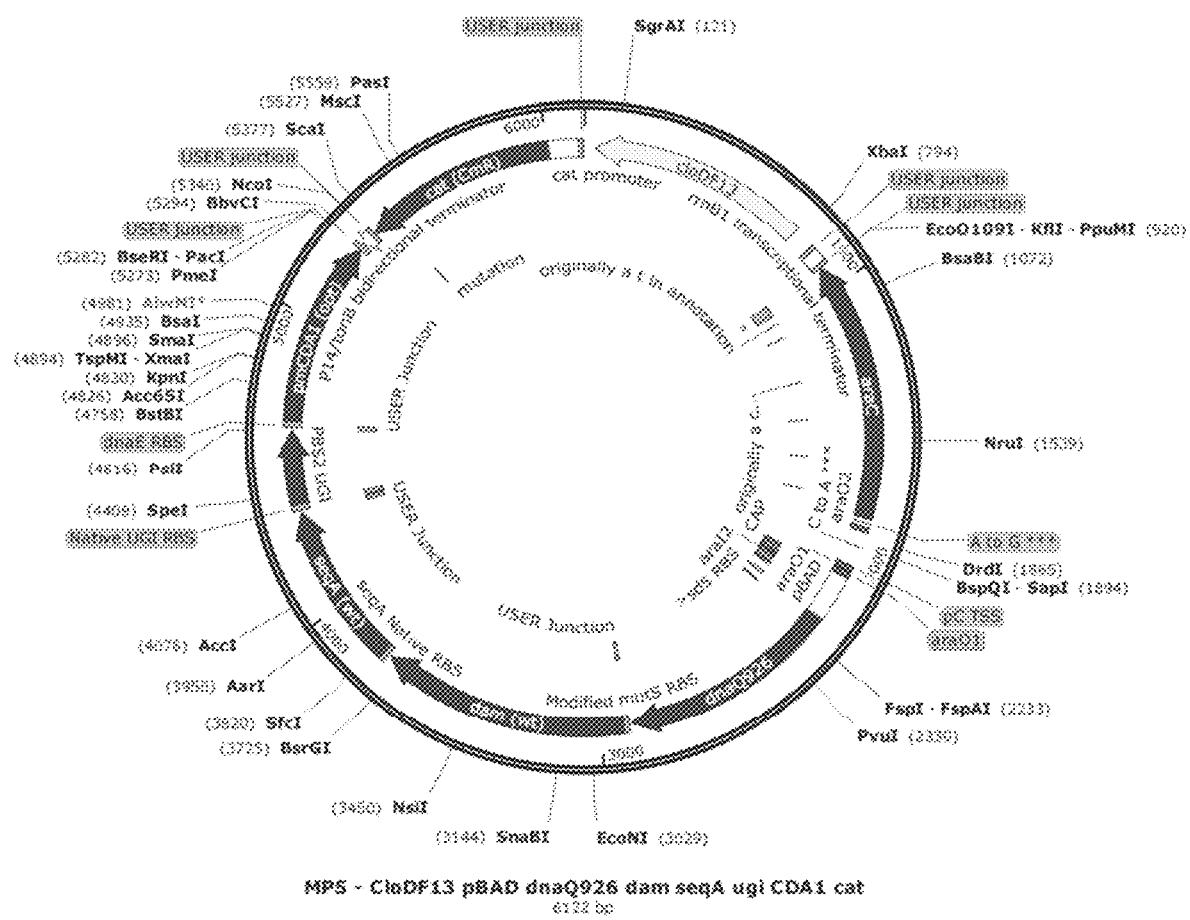
FIG. 30. MP5 Vector Map. A schematic depiction of one embodiment of a MP5 mutagenesis vector is provided, referenced herein as SEQ ID NO: 47. This embodiment comprises araC, dnaQ926, dam, seqA, ugi and pmCDA1
Figure 31:
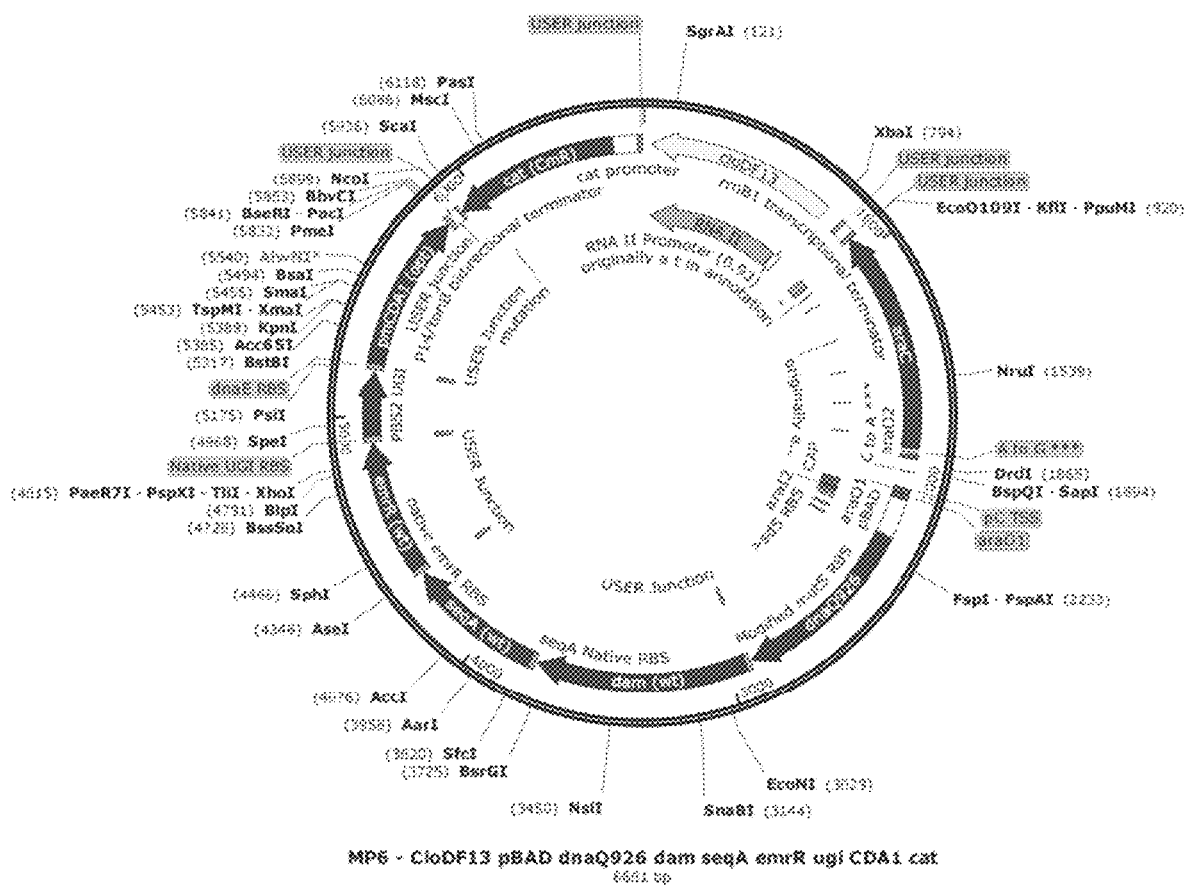
FIG. 31. MP6 Vector Map. A schematic depiction of one embodiment of a MP6 mutagenesis vector is provided, referenced herein as SEQ ID NO: 48. This embodiment comprises araC, dnaQ926, dam, seqA, emrR, ugi and pmCDA1.
Figure 32:
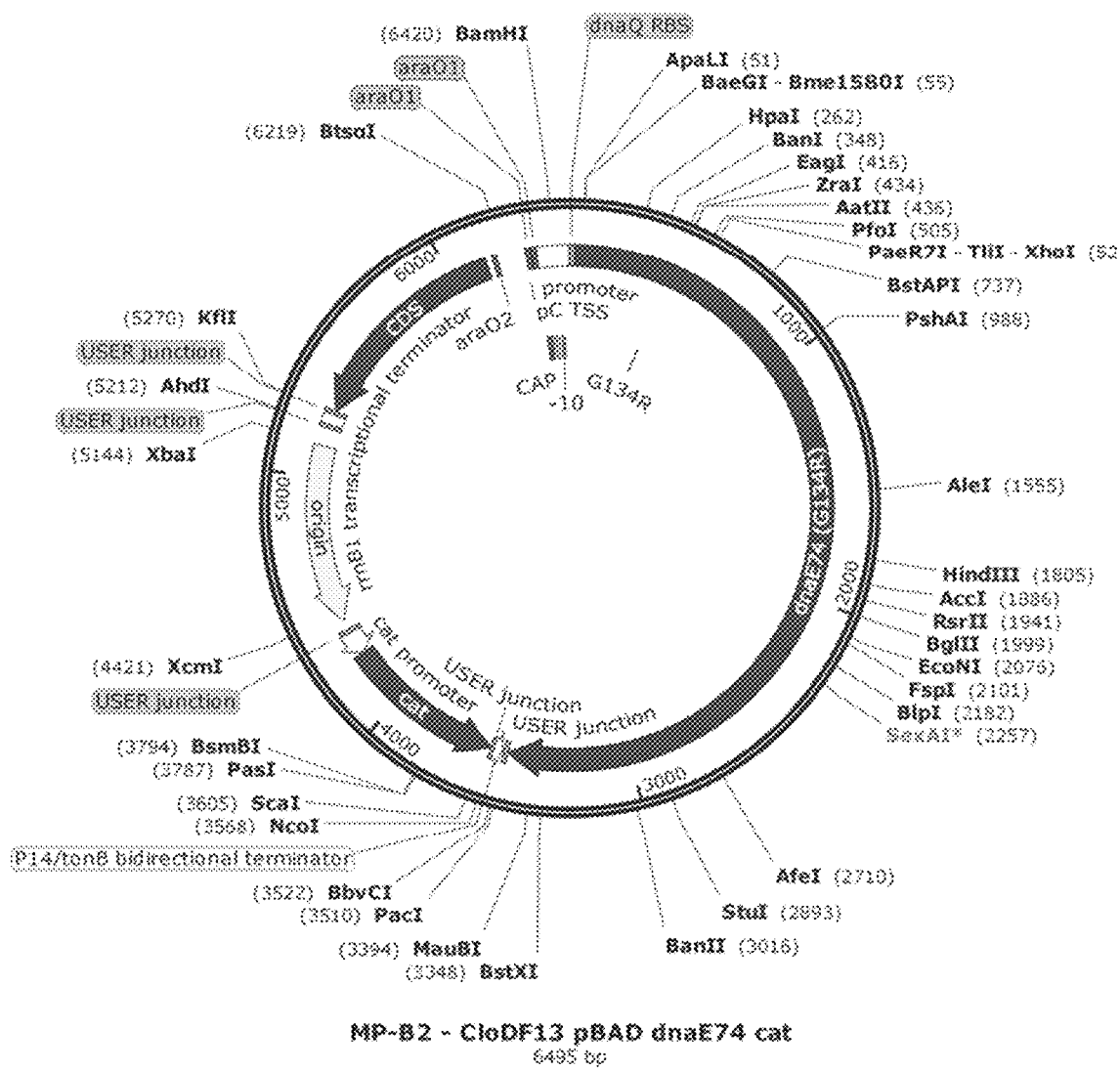
FIG. 32. MP-B2 Vector Map. A schematic depiction of one embodiment of a MP-B2 mutagenesis vector is provided, referenced herein as SEQ ID NO: 49. This embodiment comprises dnaE374.
Figure 33:
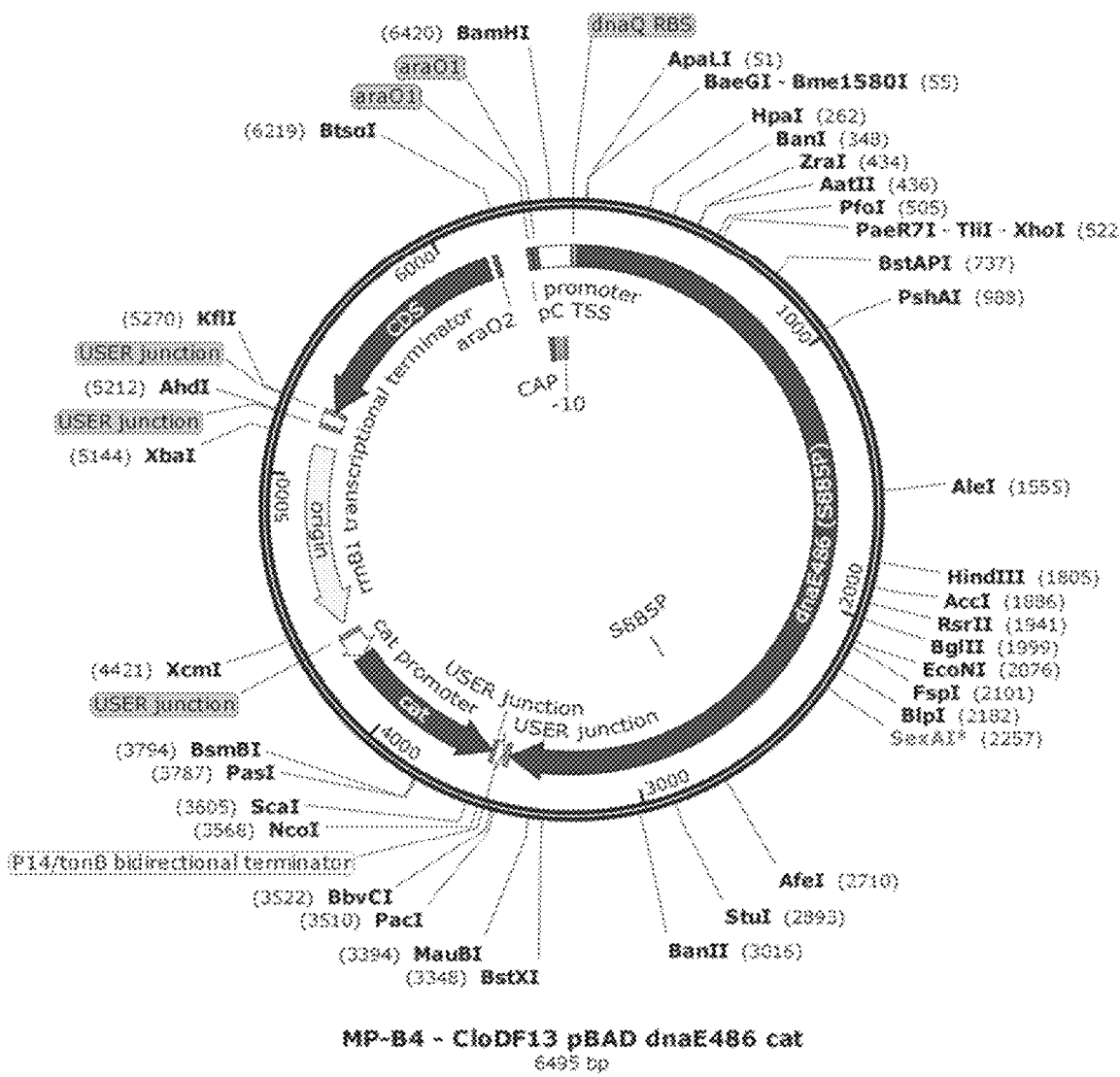
FIG. 33. MP-B4 Vector Map. A schematic depiction of one embodiment of a MP-B4 mutagenesis vector is provided, referenced herein as SEQ ID NO: 50. This embodiment comprises dnaE486.
Figure 34:
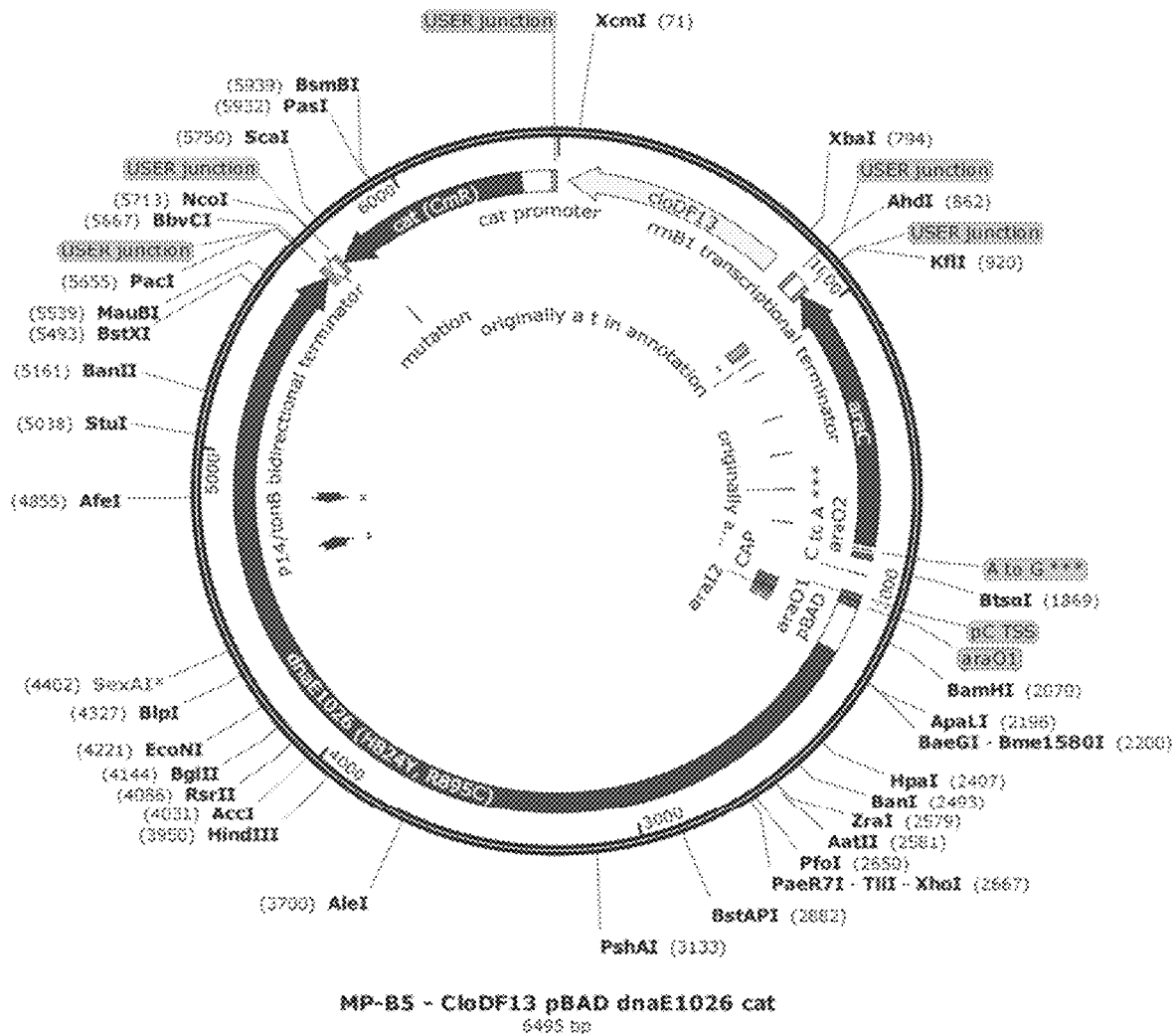
FIG. 34. MP-B5 Vector Map. A schematic depiction of one embodiment of a MP-B5 mutagenesis vector is provided, referenced herein as SEQ ID NO: 51. This embodiment comprises araC, and dnaE1026.
Figure 35:
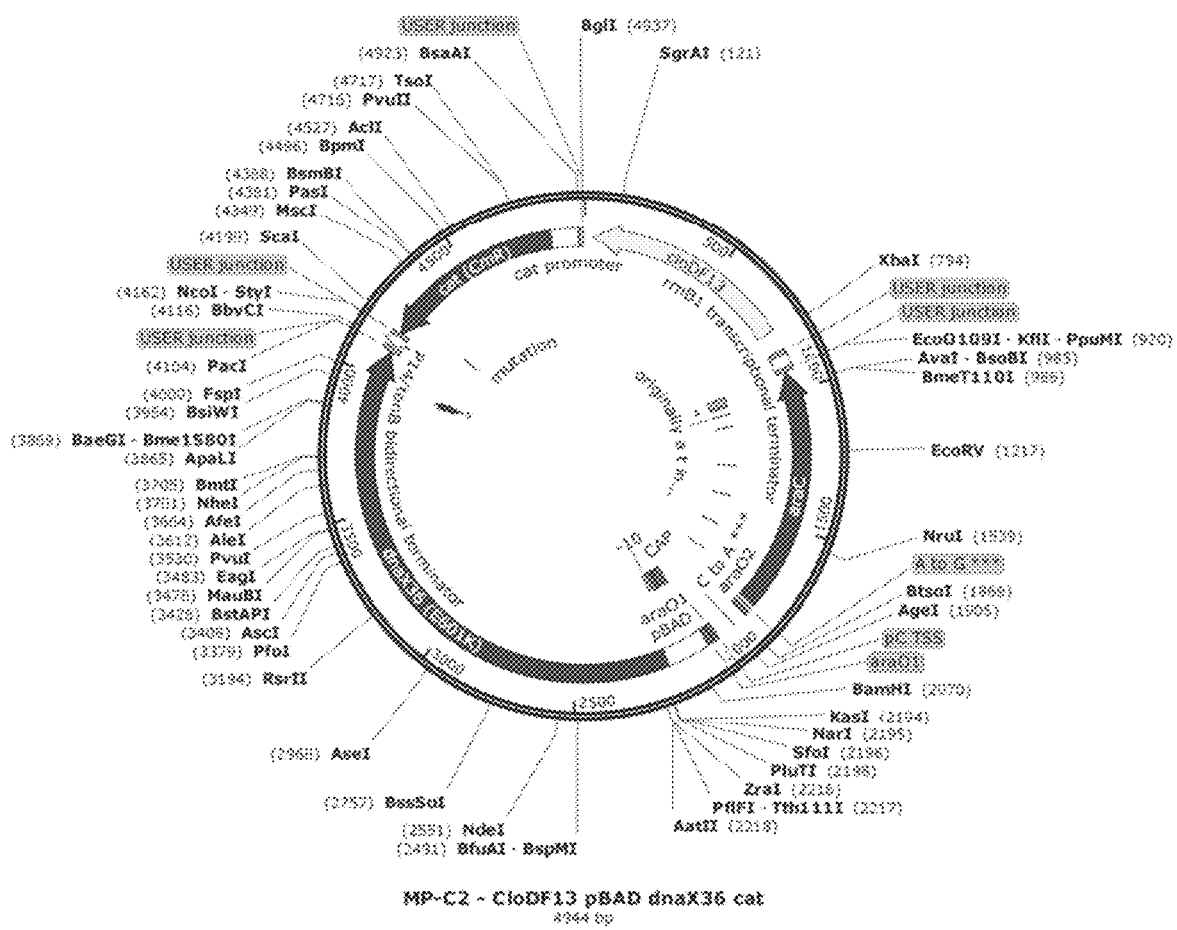
FIG. 35. MP-C2 Vector Map. A schematic depiction of one embodiment of a MP-C2 mutagenesis vector is provided, referenced herein as SEQ ID NO: 52. This embodiment comprises araC, and dnaX36.
Figure 36:
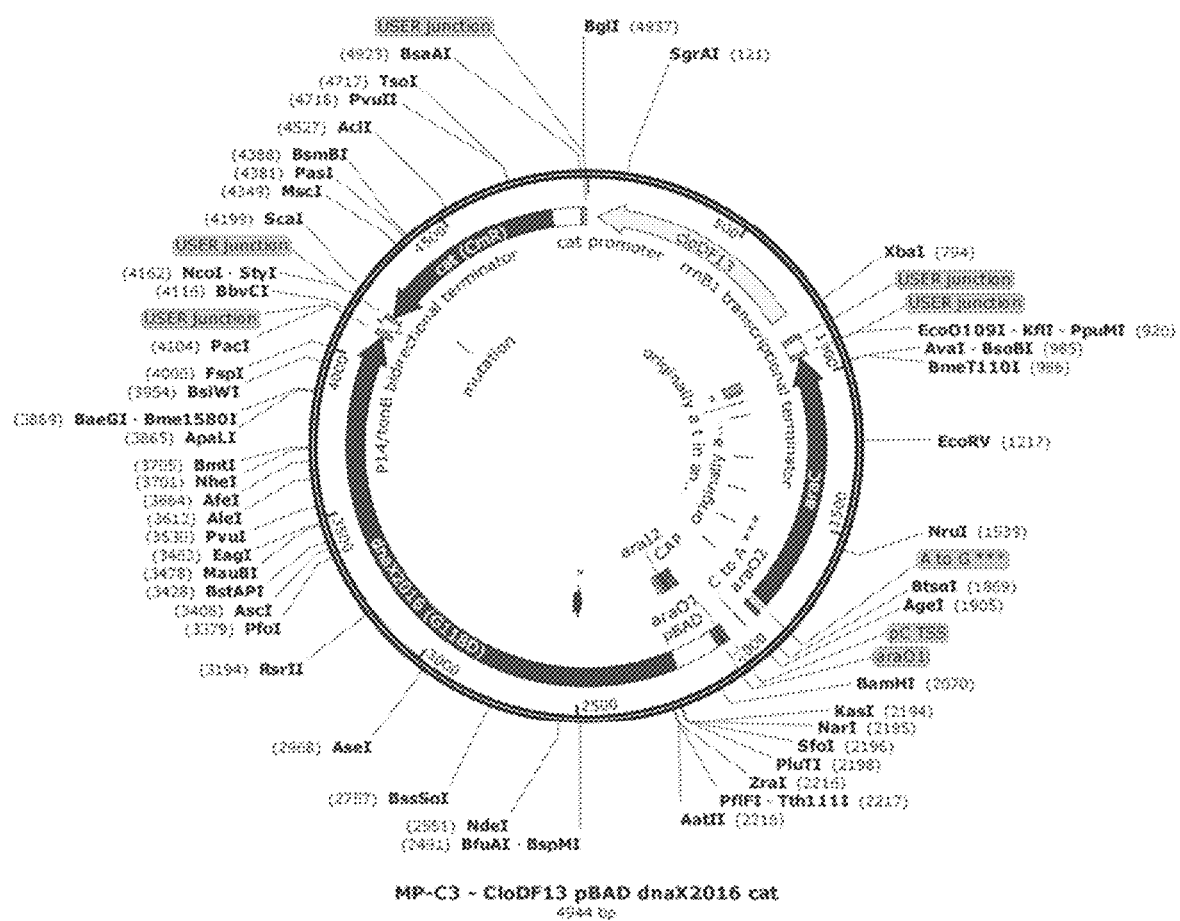
FIG. 36. MP-C3 Vector Map. A schematic depiction of one embodiment of a MP-C3 mutagenesis vector is provided, referenced herein as SEQ ID NO: 53. This embodiment comprises araC, and dnaX2016.
Figure 37:
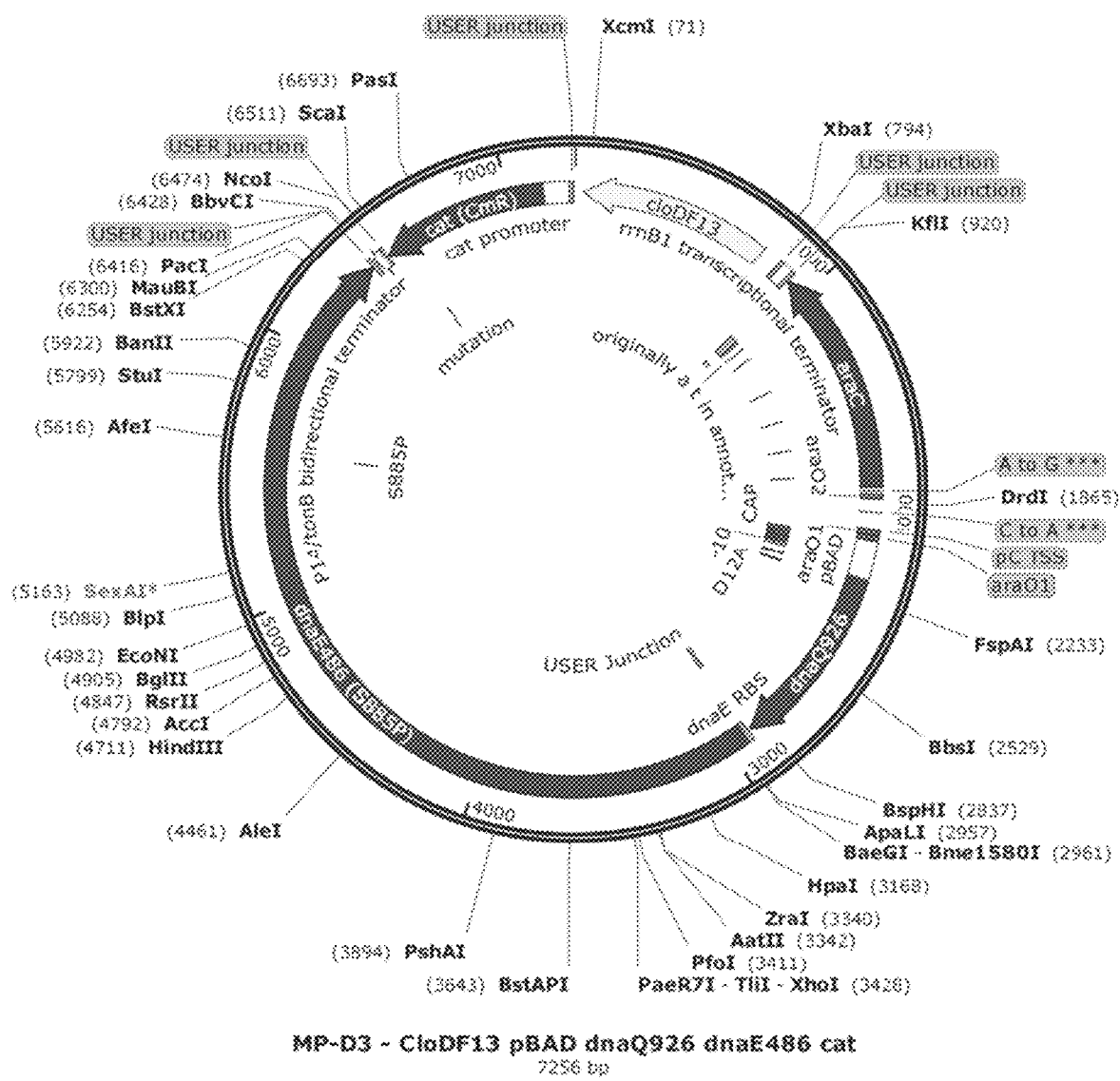
FIG. 37. MP-D3 Vector Map. A schematic depiction of one embodiment of a MP-D3 mutagenesis vector is provided, referenced herein as SEQ ID NO: 54. This embodiment comprises araC, and dnaE486.
Figure 38:
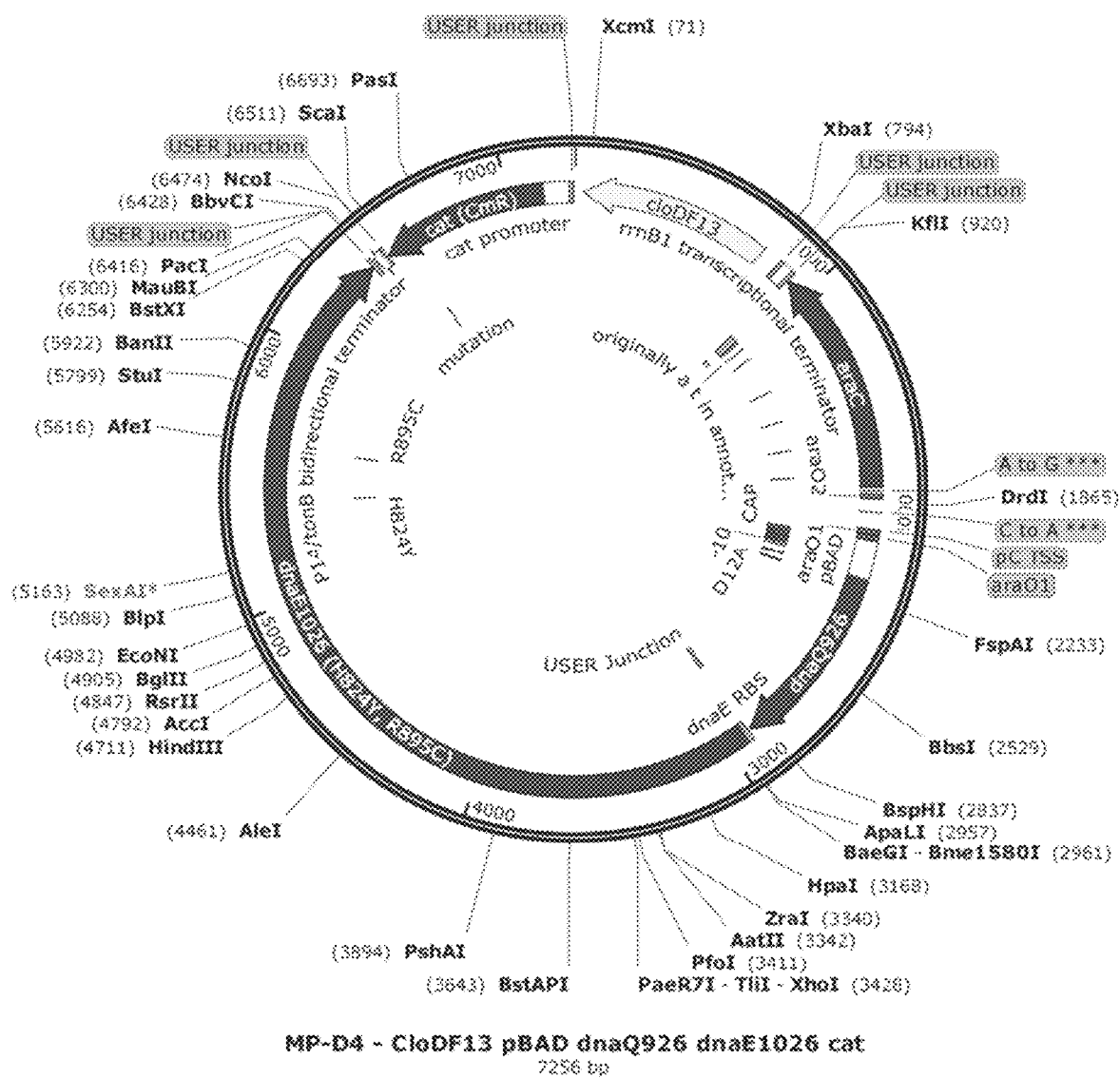
FIG. 38. MP-D4 Vector Map. A schematic depiction of one embodiment of a MP-D4 mutagenesis vector is provided, referenced herein as SEQ ID NO: 55. This embodiment comprises araC, dnaQ926, and dnaE1026.
Figure 39:
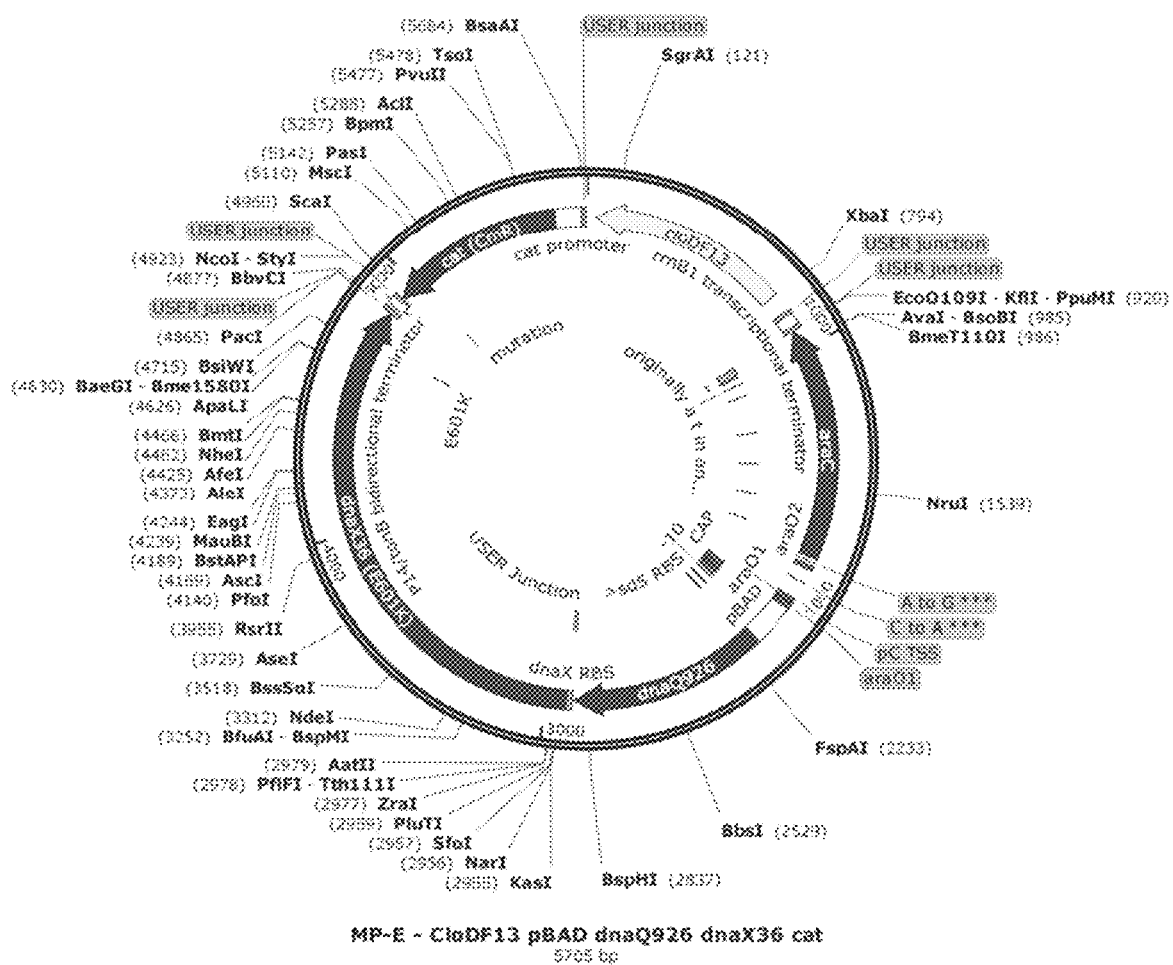
FIG. 39. MP-E Vector Map. A schematic depiction of one embodiment of a MP-E mutagenesis vector is provided, referenced herein as SEQ ID NO: 56. This embodiment comprises araC, dnaQ926, and dnaX36.
Figure 40:
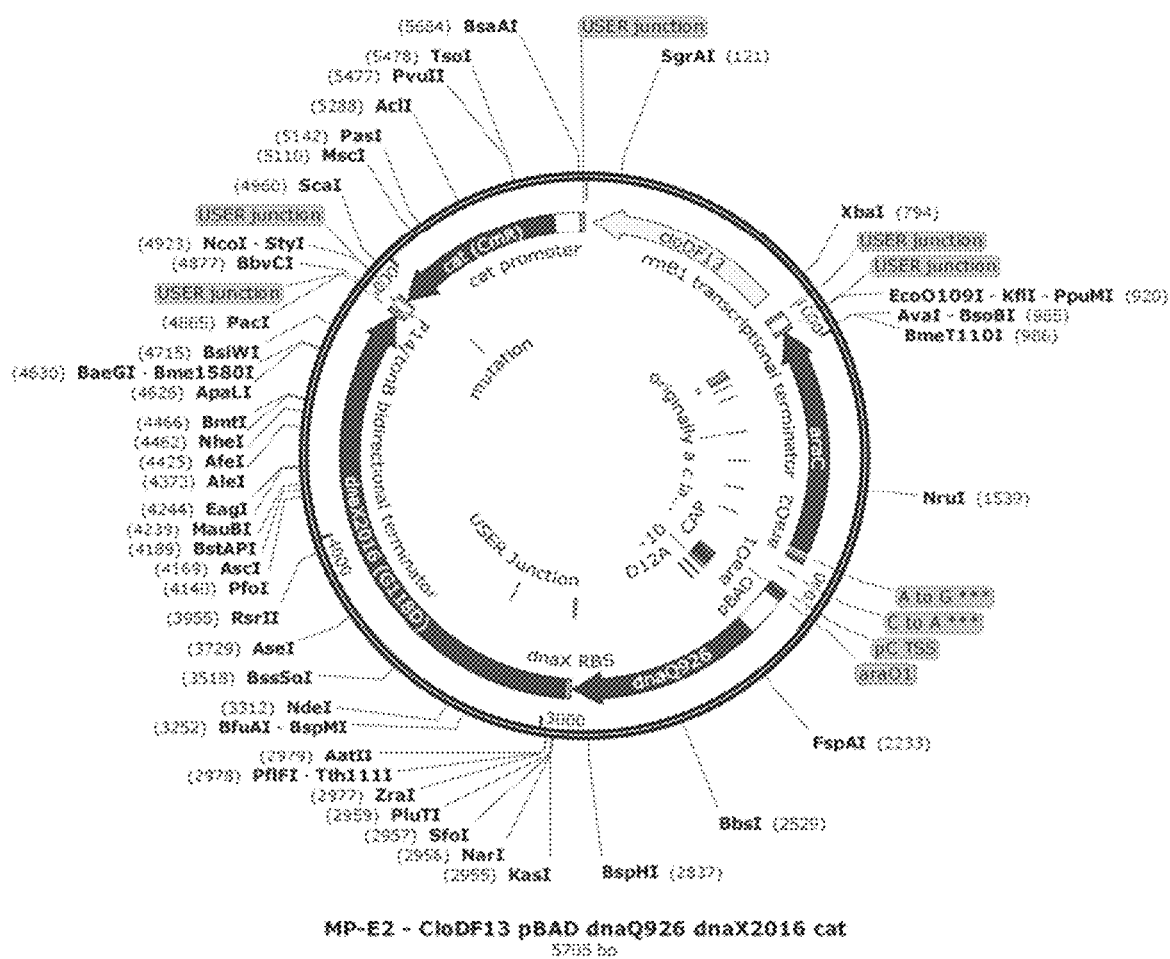
FIG. 40. MP-E2 Vector Map. A schematic depiction of one embodiment of a MP-E2 mutagenesis vector is provided, referenced herein as SEQ ID NO: 57. This embodiment comprises araC, dnaQ926, and dnaX2016.
Figure 41:
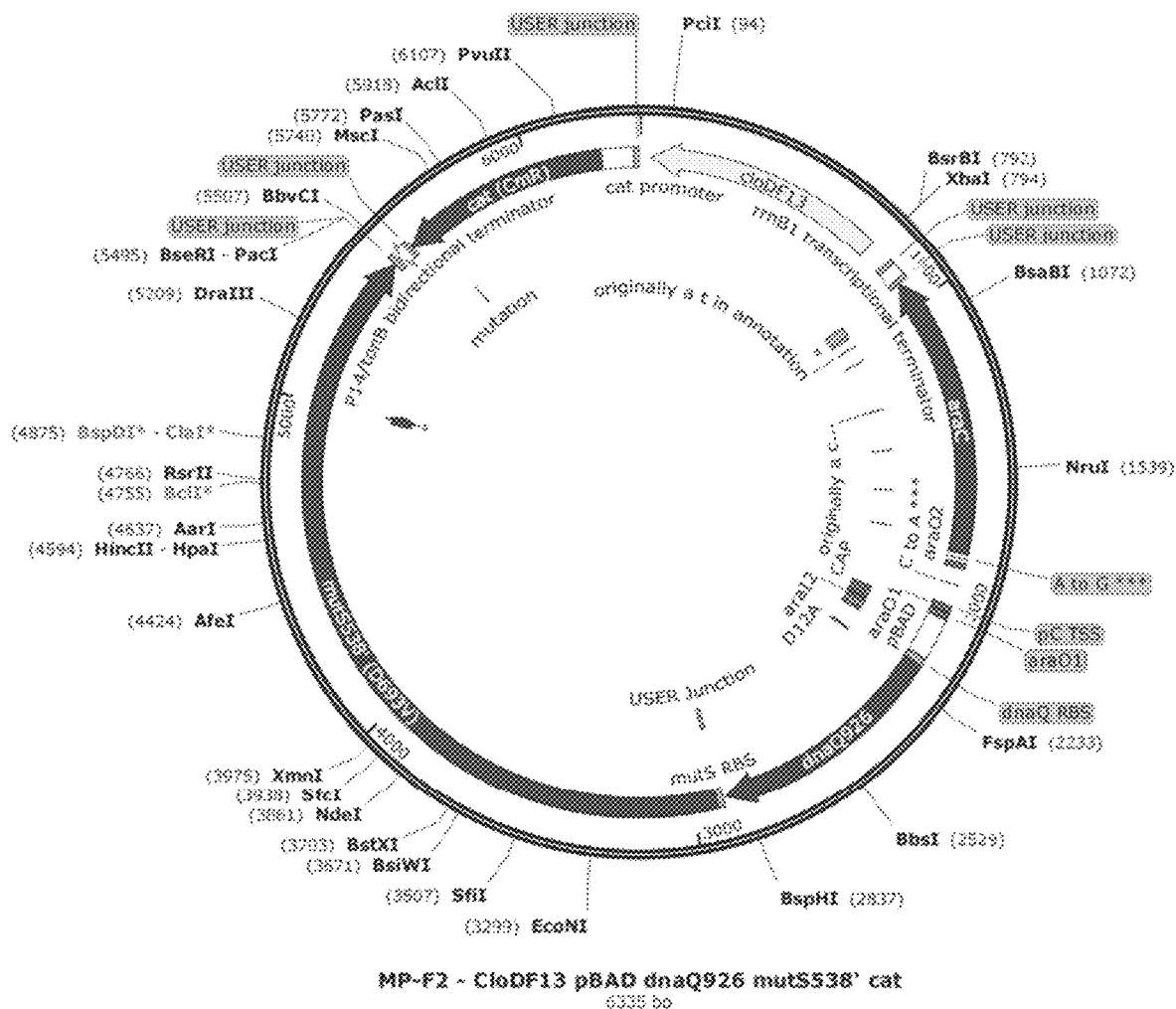
FIG. 41. MP-F2 Vector Map. A schematic depiction of one embodiment of a MP-F2 mutagenesis vector is provided, referenced herein as SEQ ID NO: 58. This embodiment comprises araC, dnaQ926, dnaX2016, and mutS538'.
Figure 42:
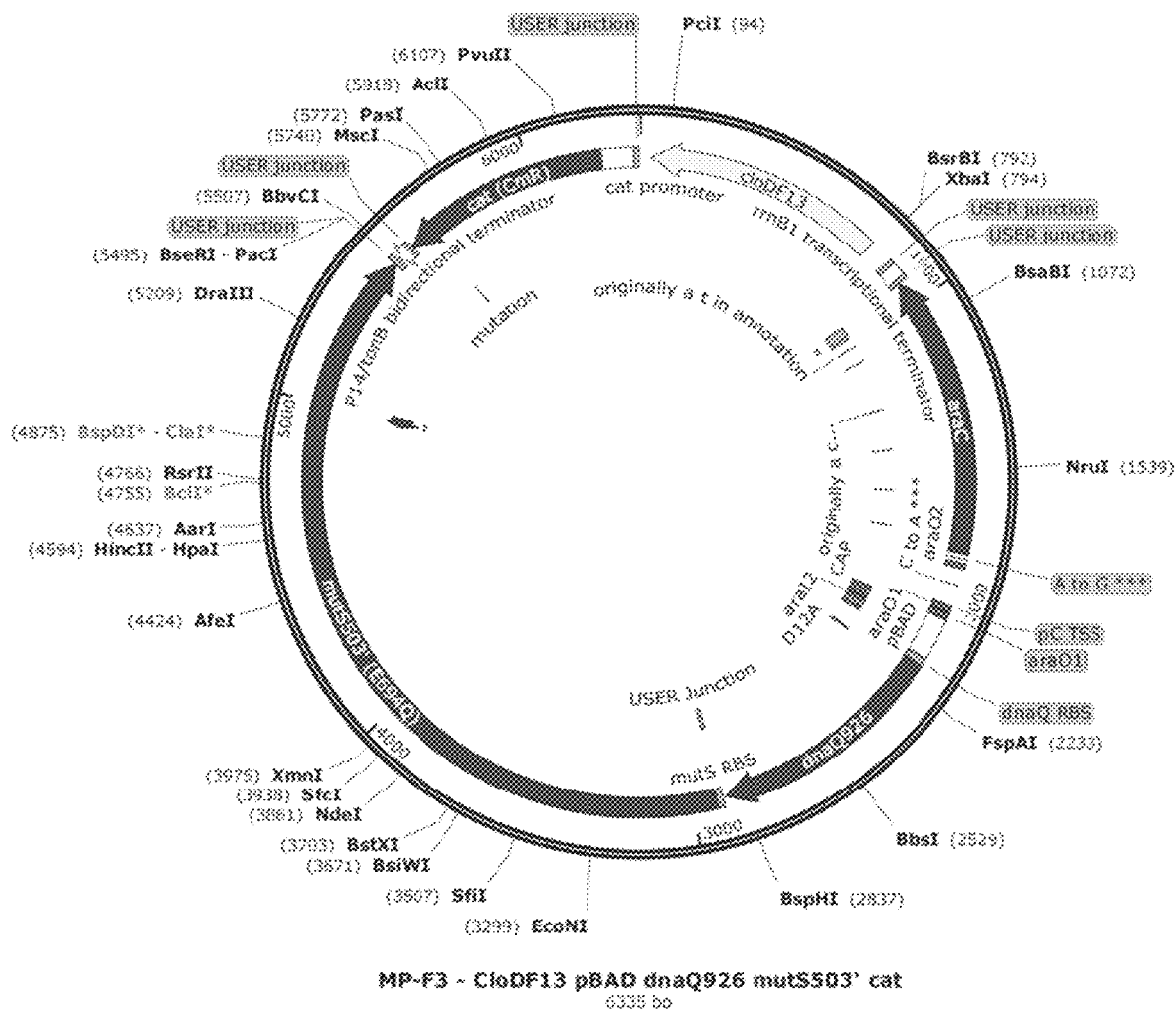
FIG. 42. MP-F3 Vector Map. A schematic depiction of one embodiment of a MP-F3 mutagenesis vector is provided, referenced herein as SEQ ID NO: 59. This embodiment comprises araC, dnaQ926, and mutS503'.
Figure 43:
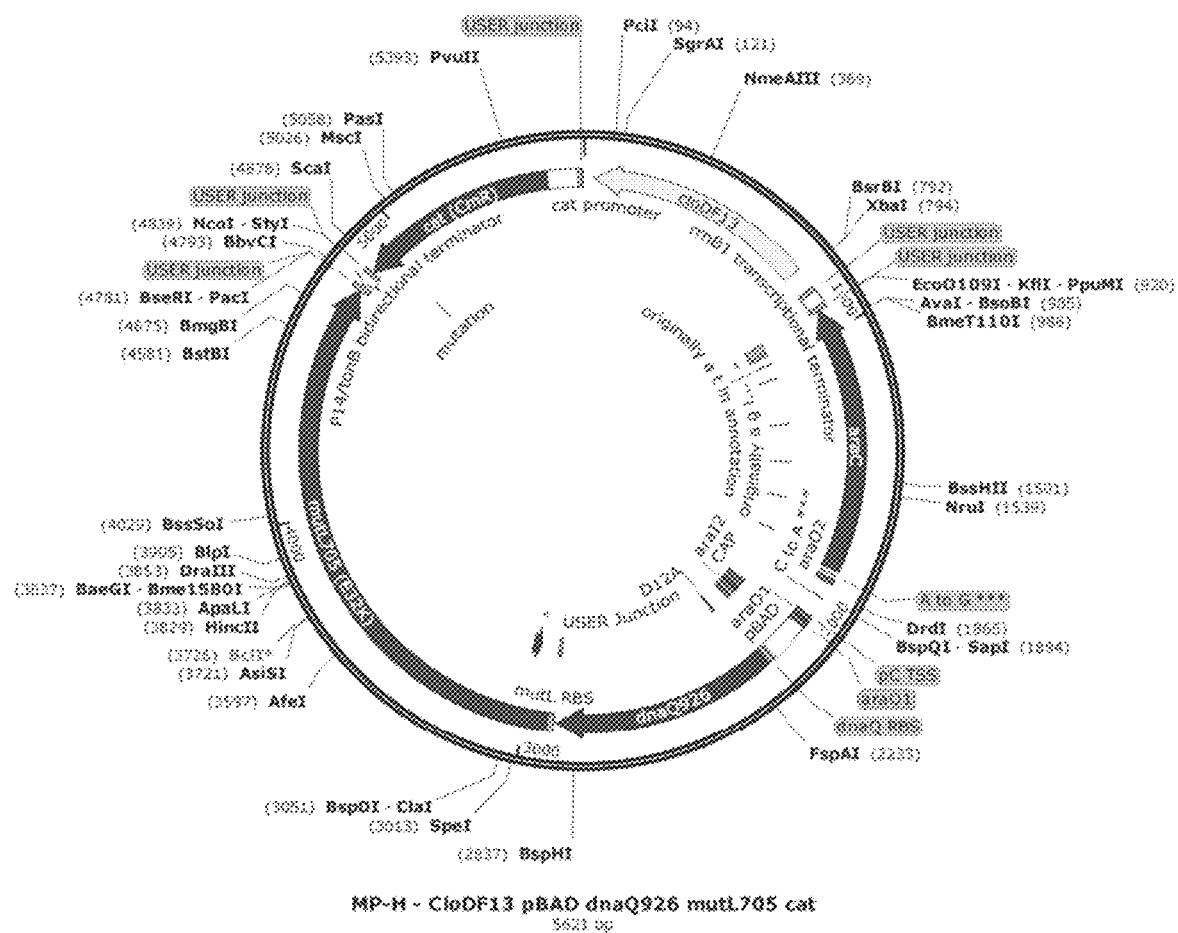
FIG. 43. MP-H Vector Map. A schematic depiction of one embodiment of a MP-H mutagenesis vector is provided, referenced herein as SEQ ID NO: 60. This embodiment comprises araC, dnaQ926, and mutL705.
Figure 44:
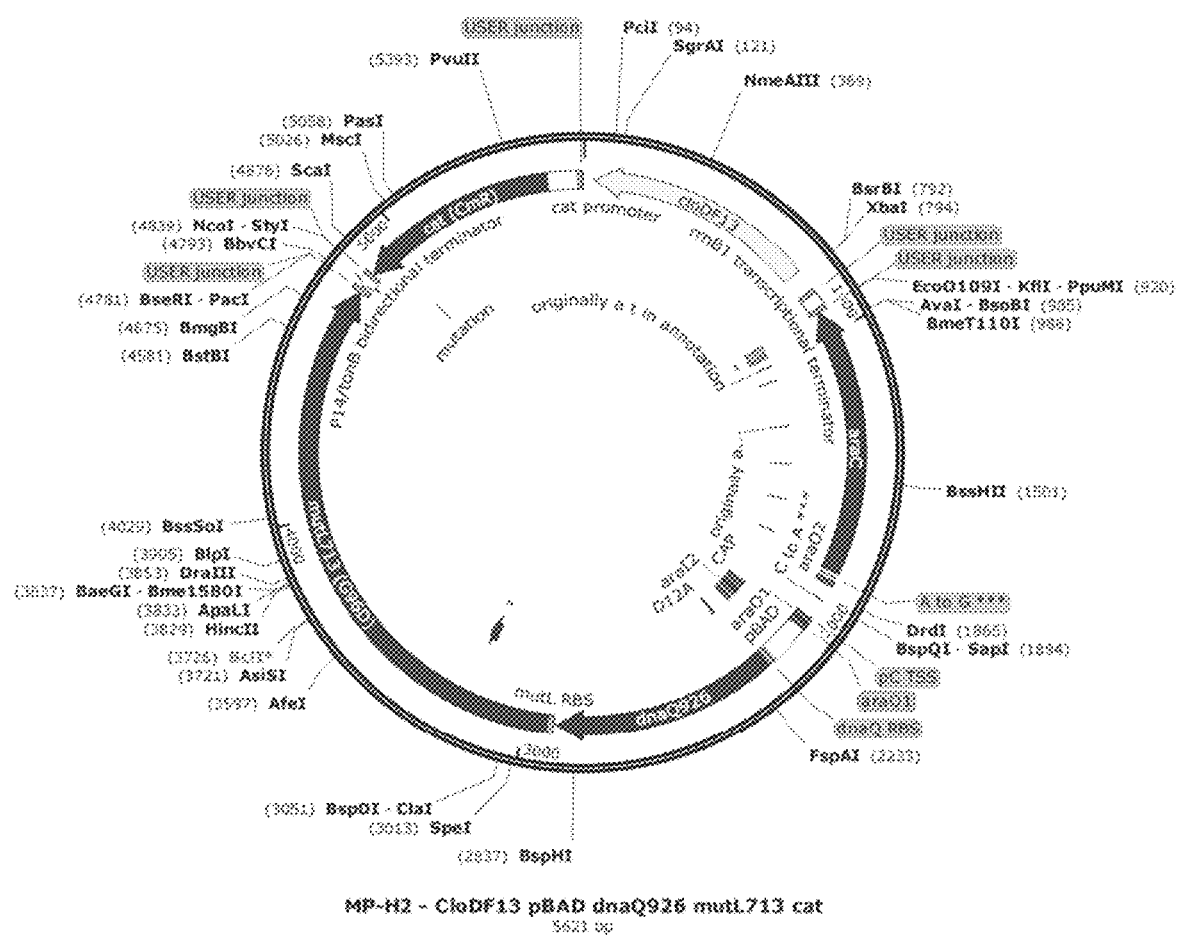
FIG. 44. MP-H2 Vector Map. A schematic depiction of one embodiment of a MP-H2 mutagenesis vector is provided, referenced herein as SEQ ID NO: 61. This embodiment comprises araC, dnaQ926, and mutL713.
Figure 45:
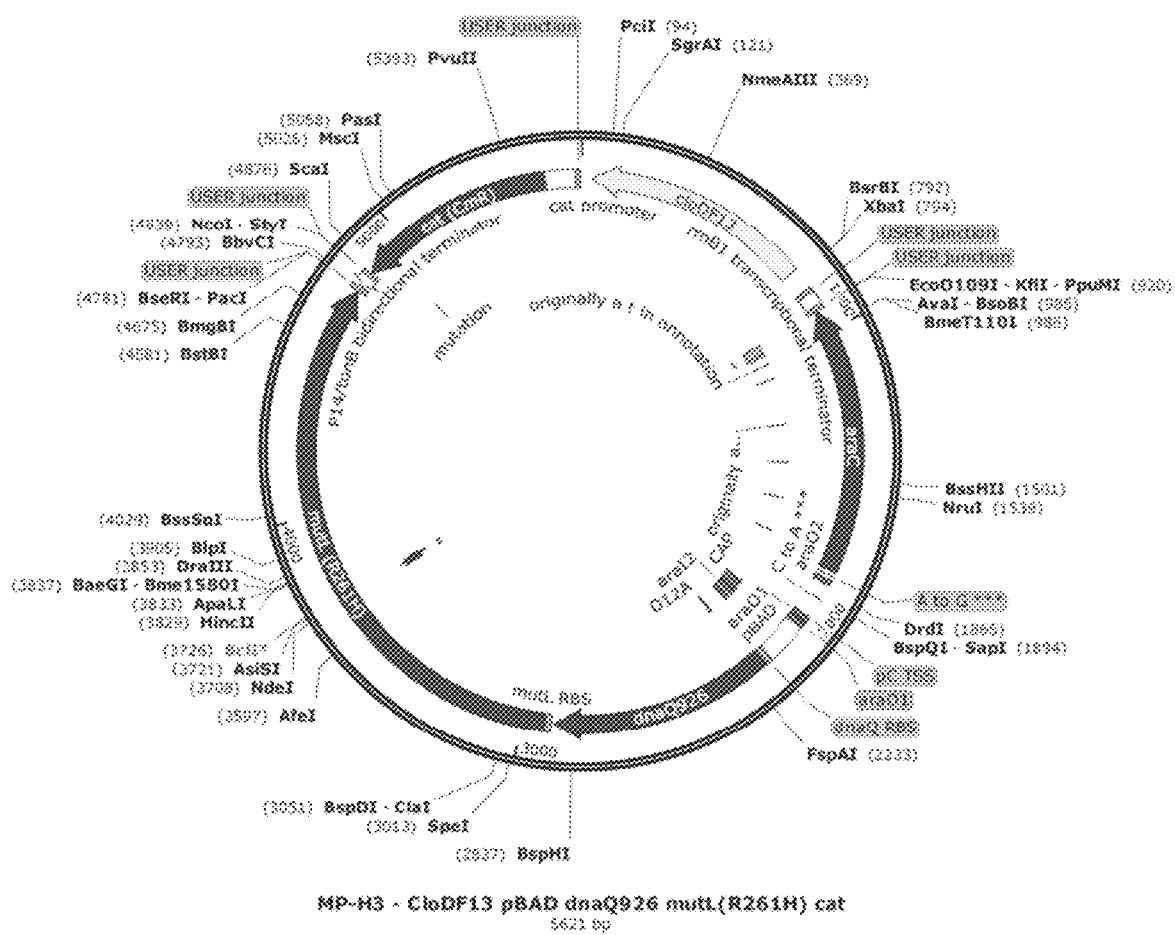
FIG. 45. MP-H3 Vector Map. A schematic depiction of one embodiment of a MP-H3 mutagenesis vector is provided, referenced herein as SEQ ID NO: 62. This embodiment comprises araC, dnaQ926, and mutL(R261H).
Figure 46:
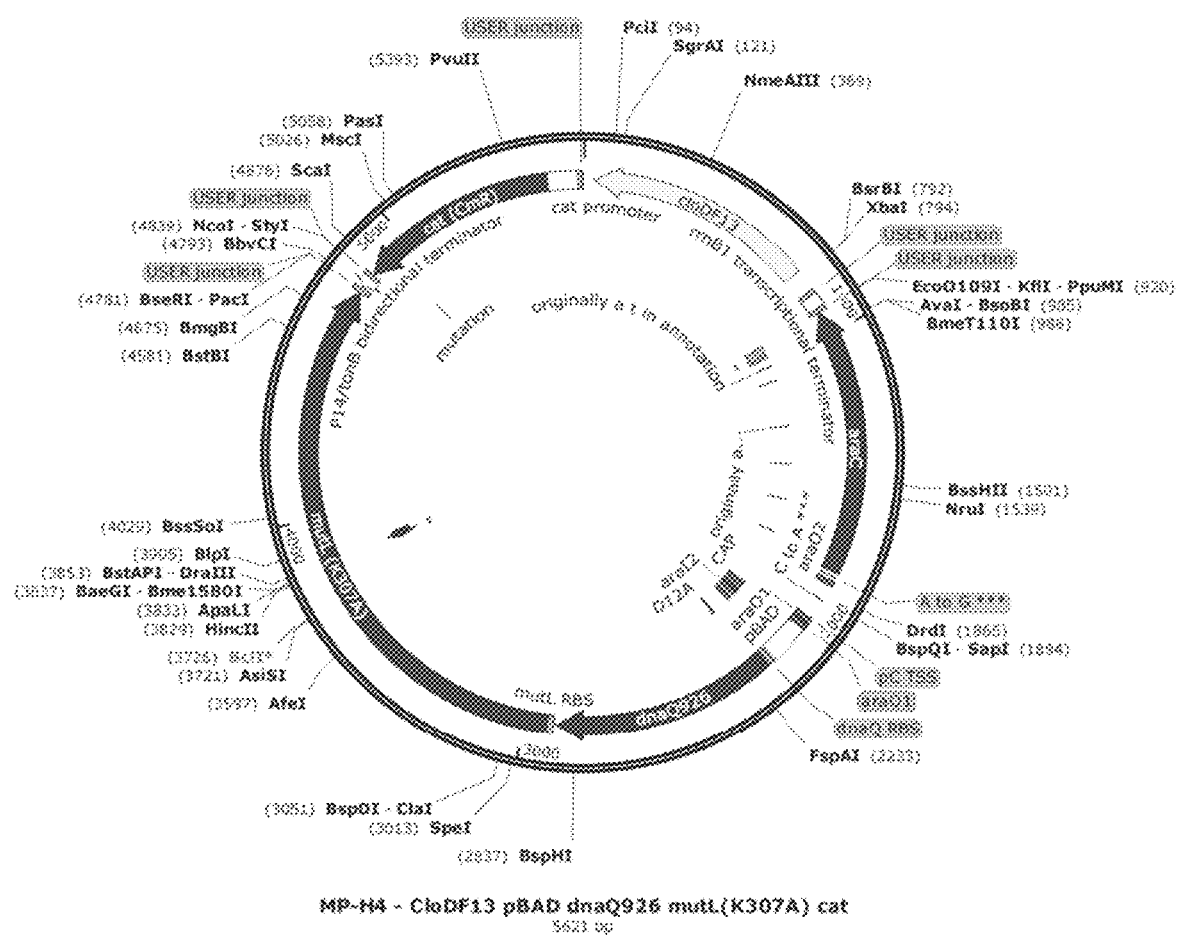
FIG. 46. MP-H4 Vector Map. A schematic depiction of one embodiment of a MP-H4 mutagenesis vector is provided, referenced herein as SEQ ID NO: 63. This embodiment comprises araC, dnaQ926, and mutL(K307A).
Figure 47:
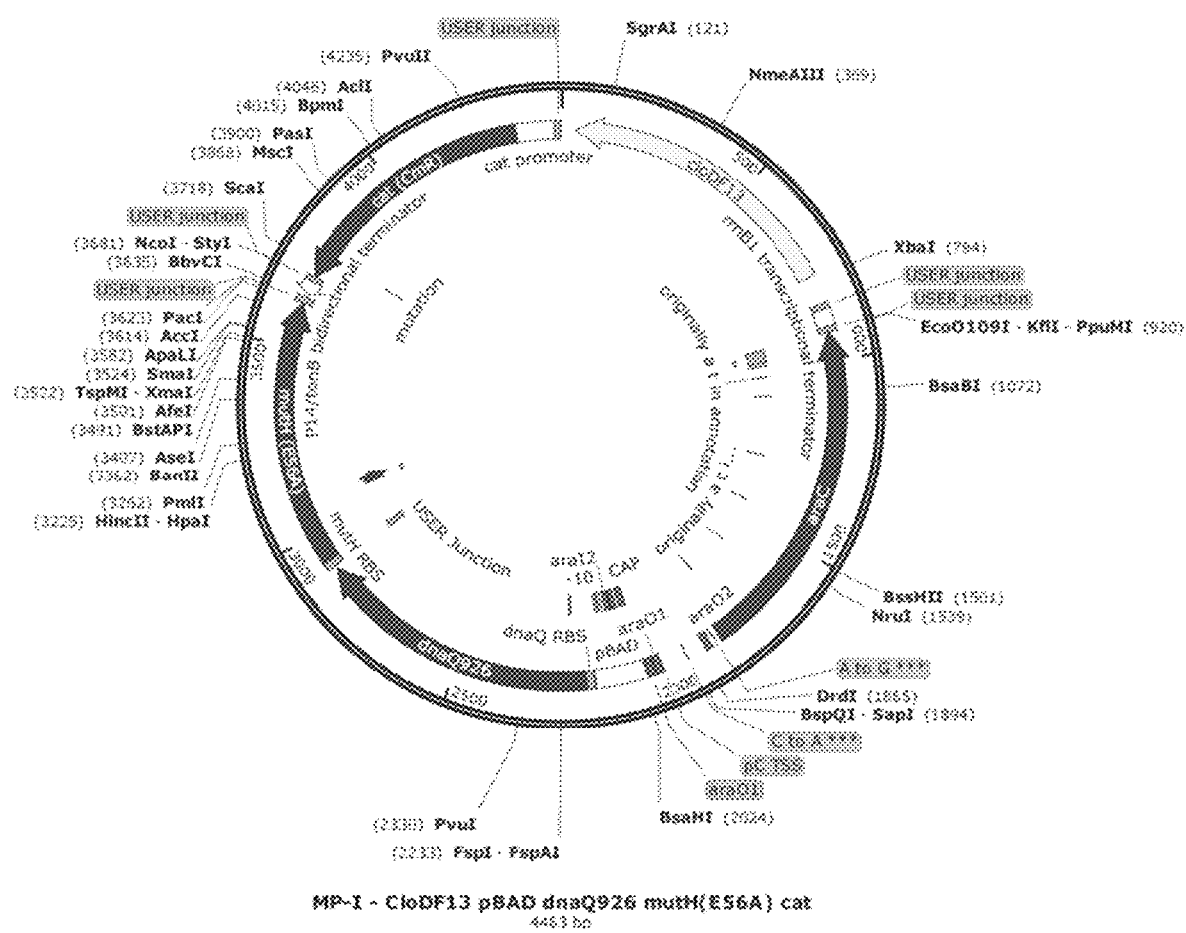
FIG. 47. MP-I Vector Map. A schematic depiction of one embodiment of a MP-I mutagenesis vector is provided, referenced herein as SEQ ID NO: 64. This embodiment comprises araC, dnaQ926, and mutH (E564).
Figure 48:
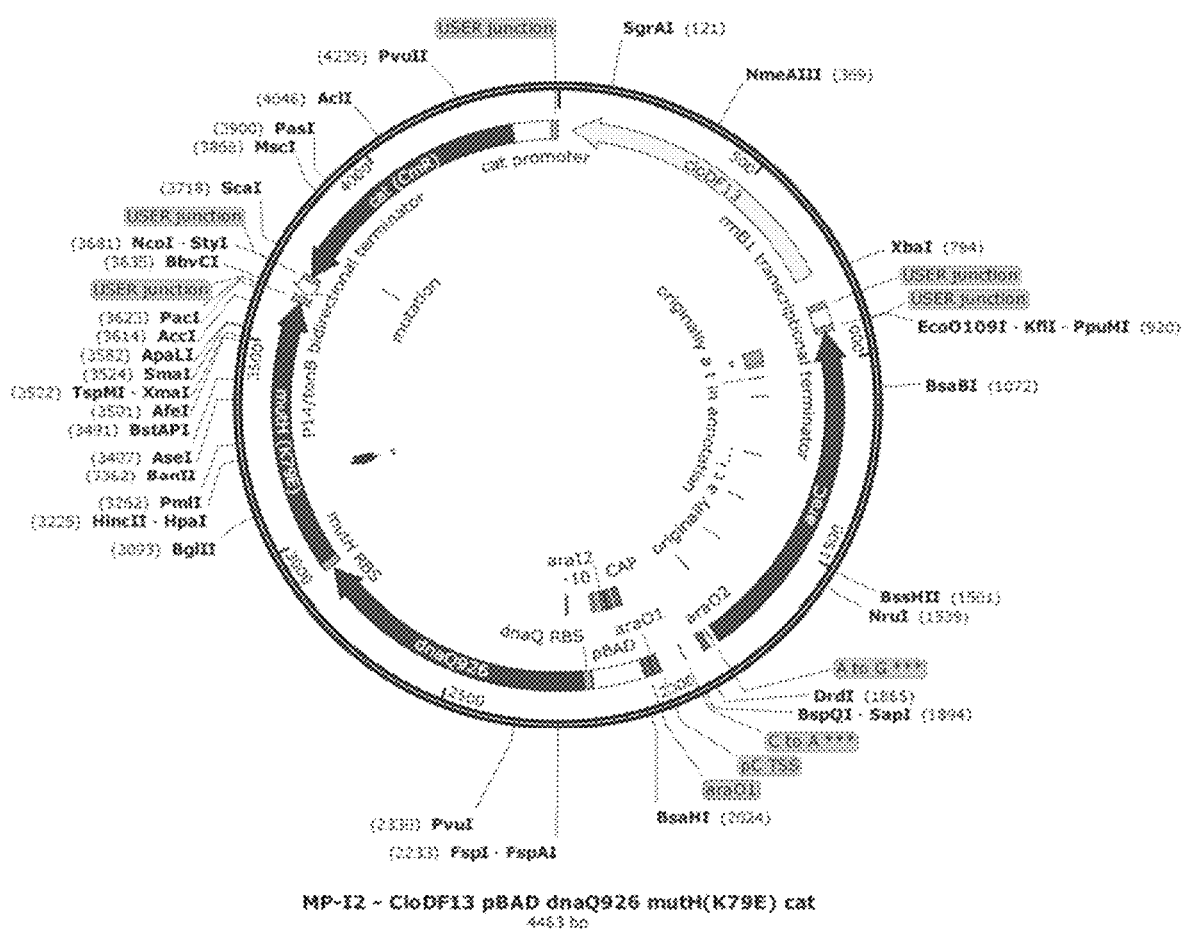
FIG. 48. MP-I2 Vector Map. A schematic depiction of one embodiment of a MP-I2 mutagenesis vector is provided, referenced herein as SEQ ID NO: 65. This embodiment comprises araC, dnaQ926, and mutH (K79E).
Figure 49:
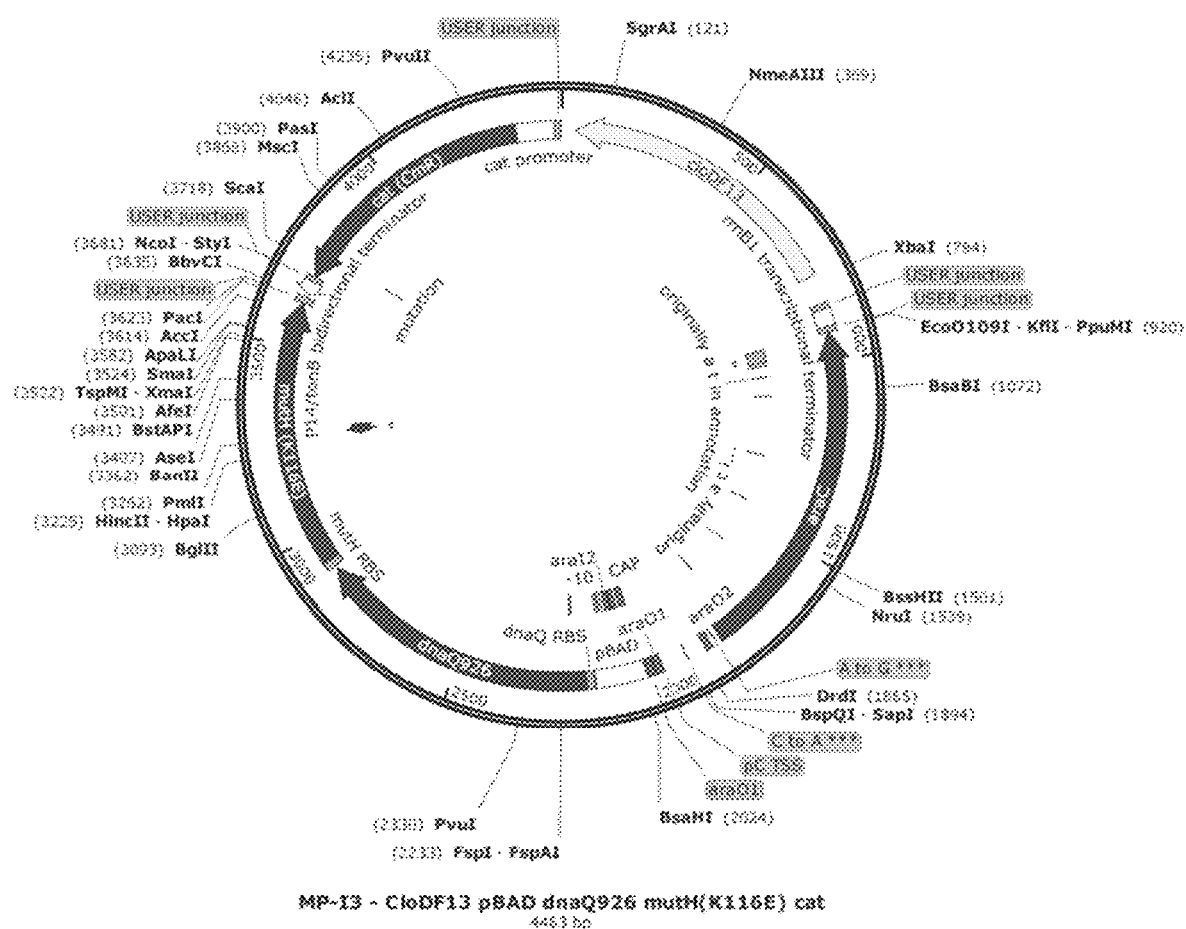
FIG. 49. MP-I3 Vector Map. A schematic depiction of one embodiment of a MP-I3 mutagenesis vector is provided, referenced herein as SEQ ID NO: 66. This embodiment comprises araC, dnaQ926, and mutH (K116E).
Figure 50:
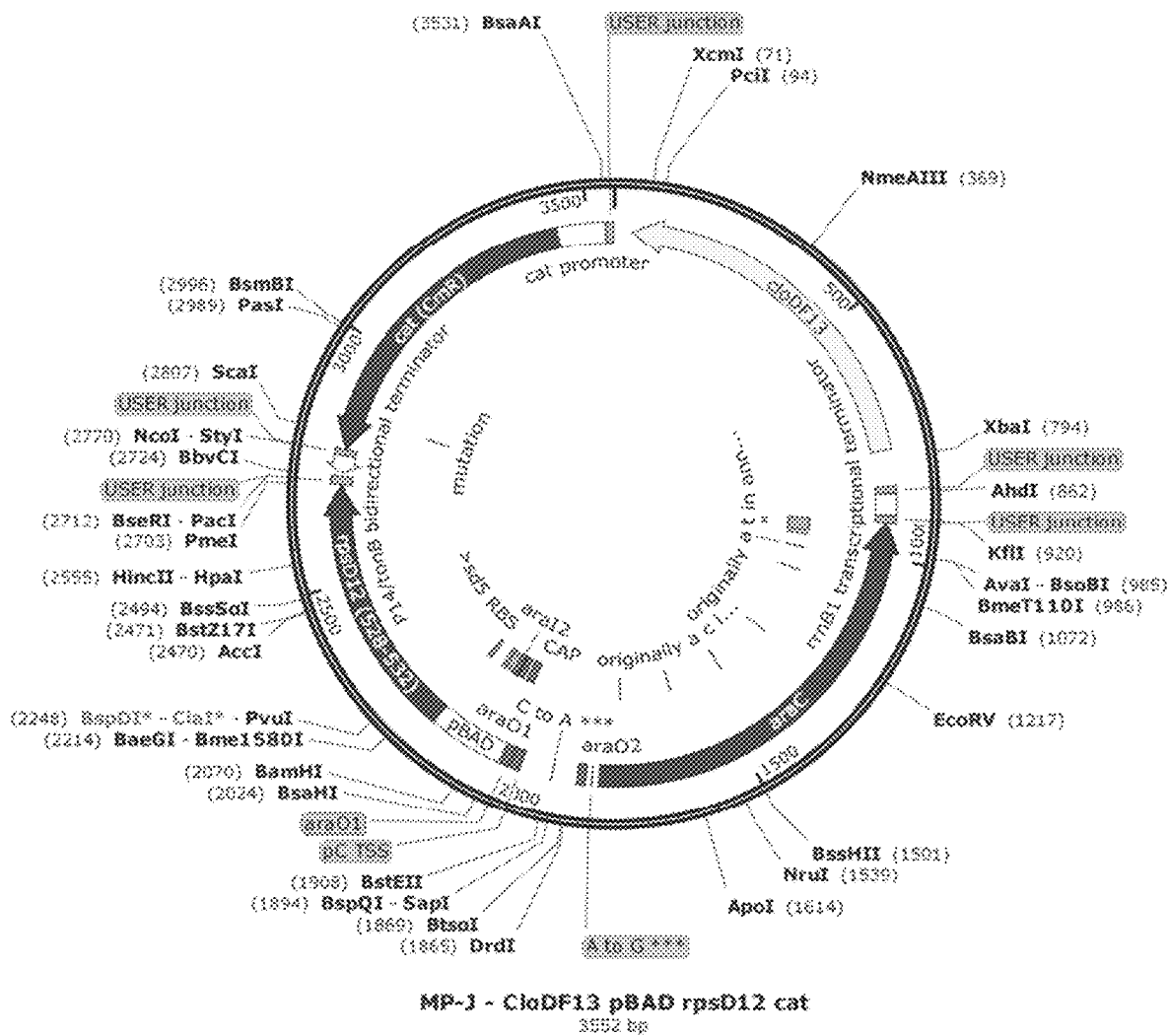
FIG. 50. MP-J Vector Map. A schematic depiction of one embodiment of a MP-J mutagenesis vector is provided, referenced herein as SEQ ID NO: 67. This embodiment comprises araC, and rpsD12.
Figure 51:
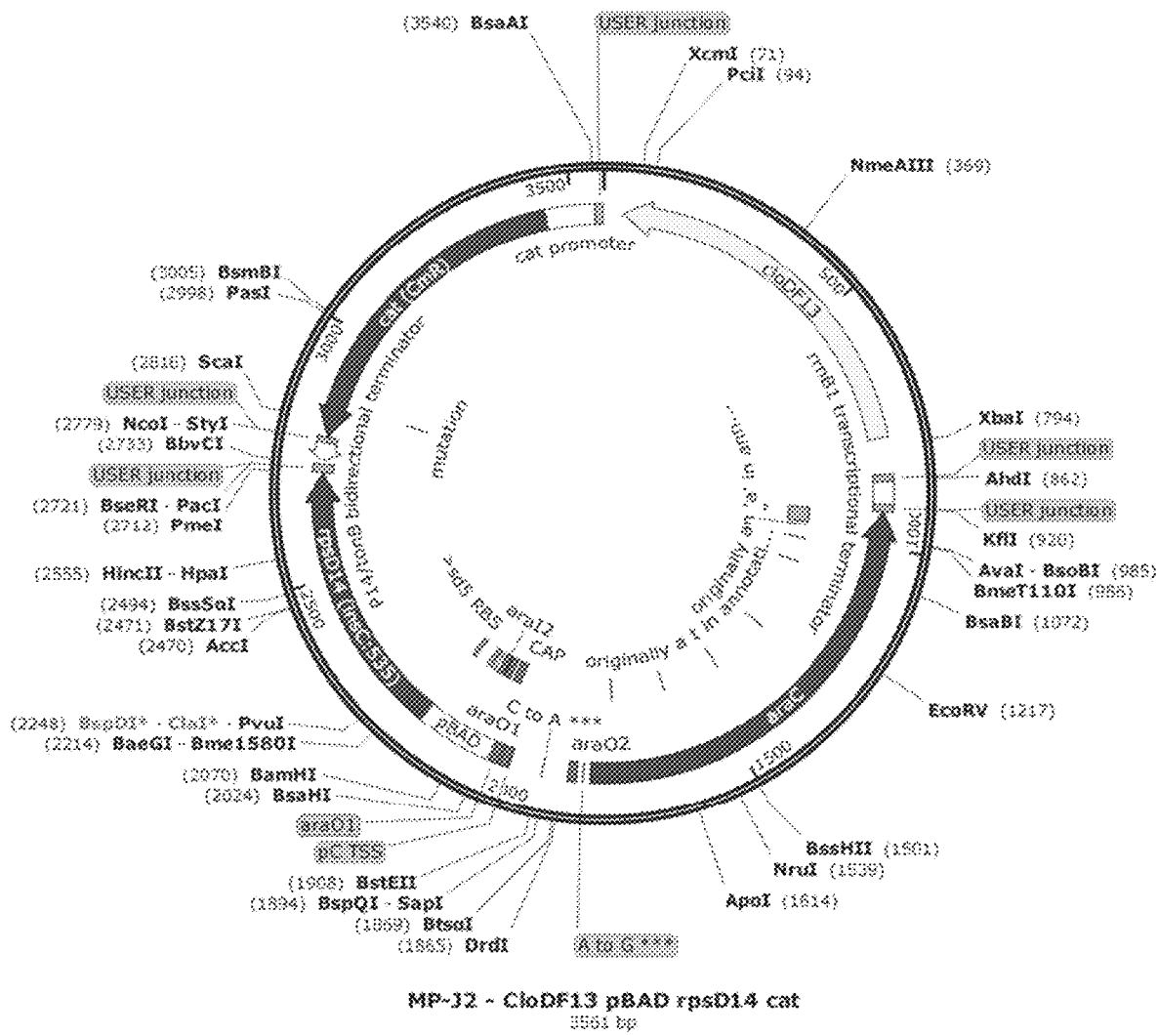
FIG. 51. MP-J2 Vector Map. A schematic depiction of one embodiment of a MP-J2 mutagenesis vector is provided, referenced herein as SEQ ID NO: 68. This embodiment comprises araC, and rpsD14.
Figure 52:
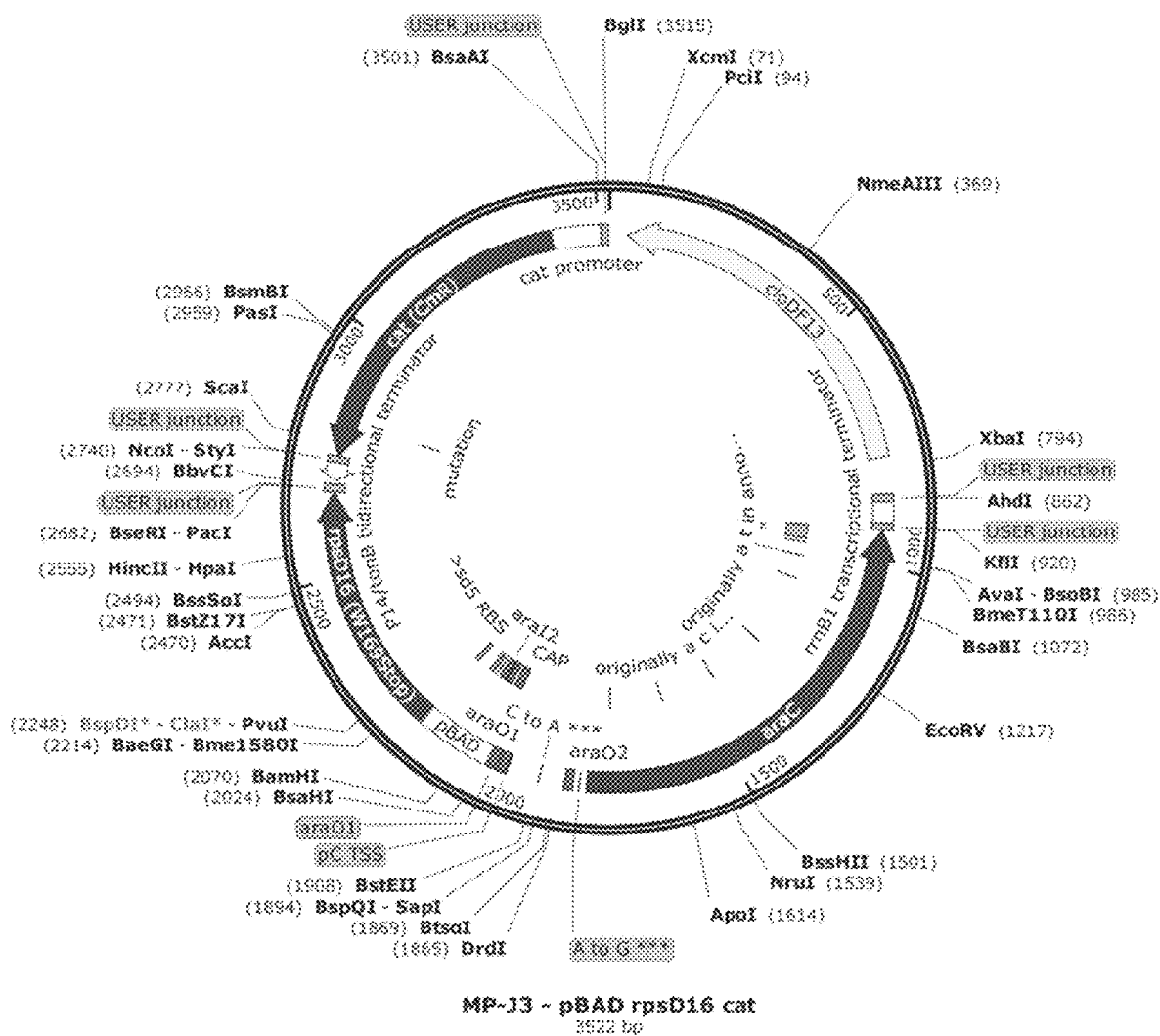
FIG. 52. MP-J3 Vector Map. A schematic depiction of one embodiment of a MP-J3 mutagenesis vector is provided, referenced herein as SEQ ID NO: 69. This embodiment comprises araC, and rpsD16.
Figure 53:
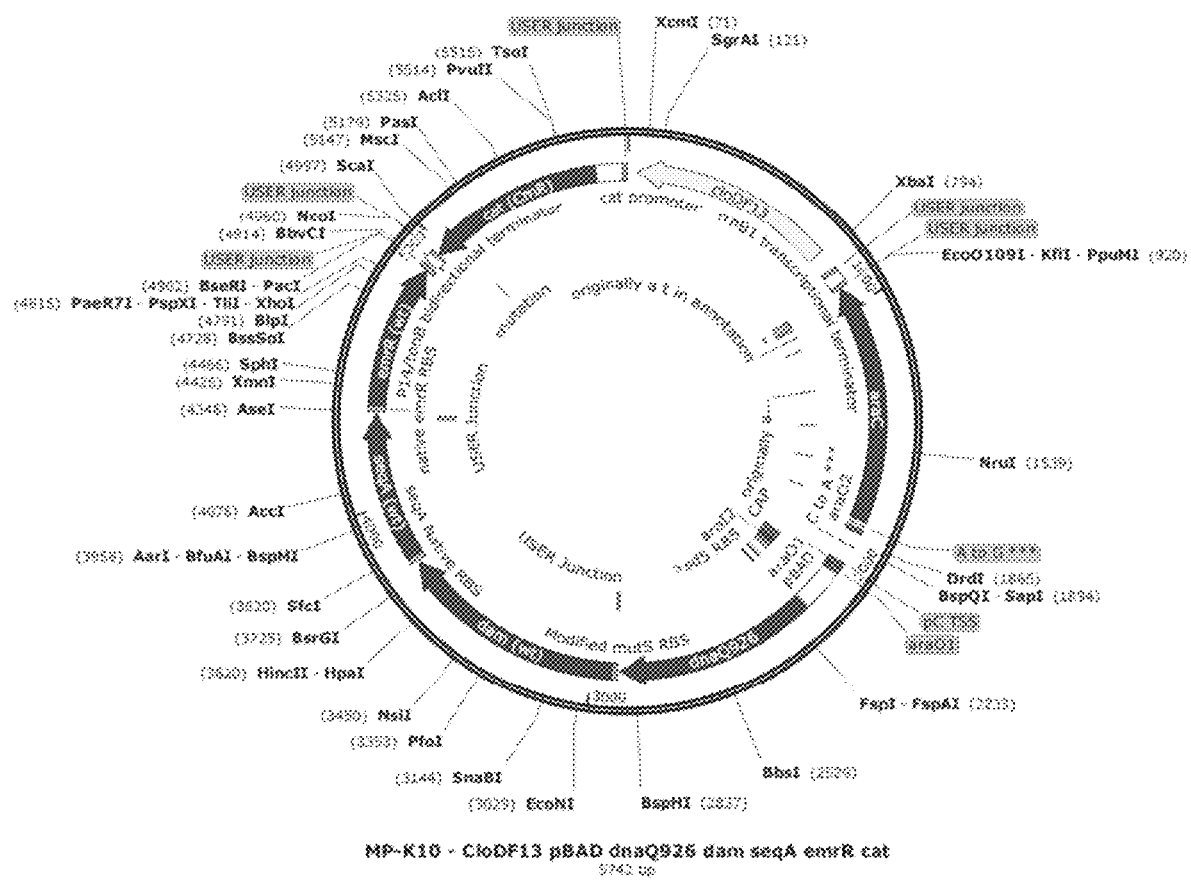
FIG. 53. MP-K10 Vector Map. A schematic depiction of one embodiment of a MP-K10 mutagenesis vector is provided, referenced herein as SEQ ID NO: 70. This embodiment comprises araC, dnaQ926, dam, seqA, and emrR.
Figure 54:
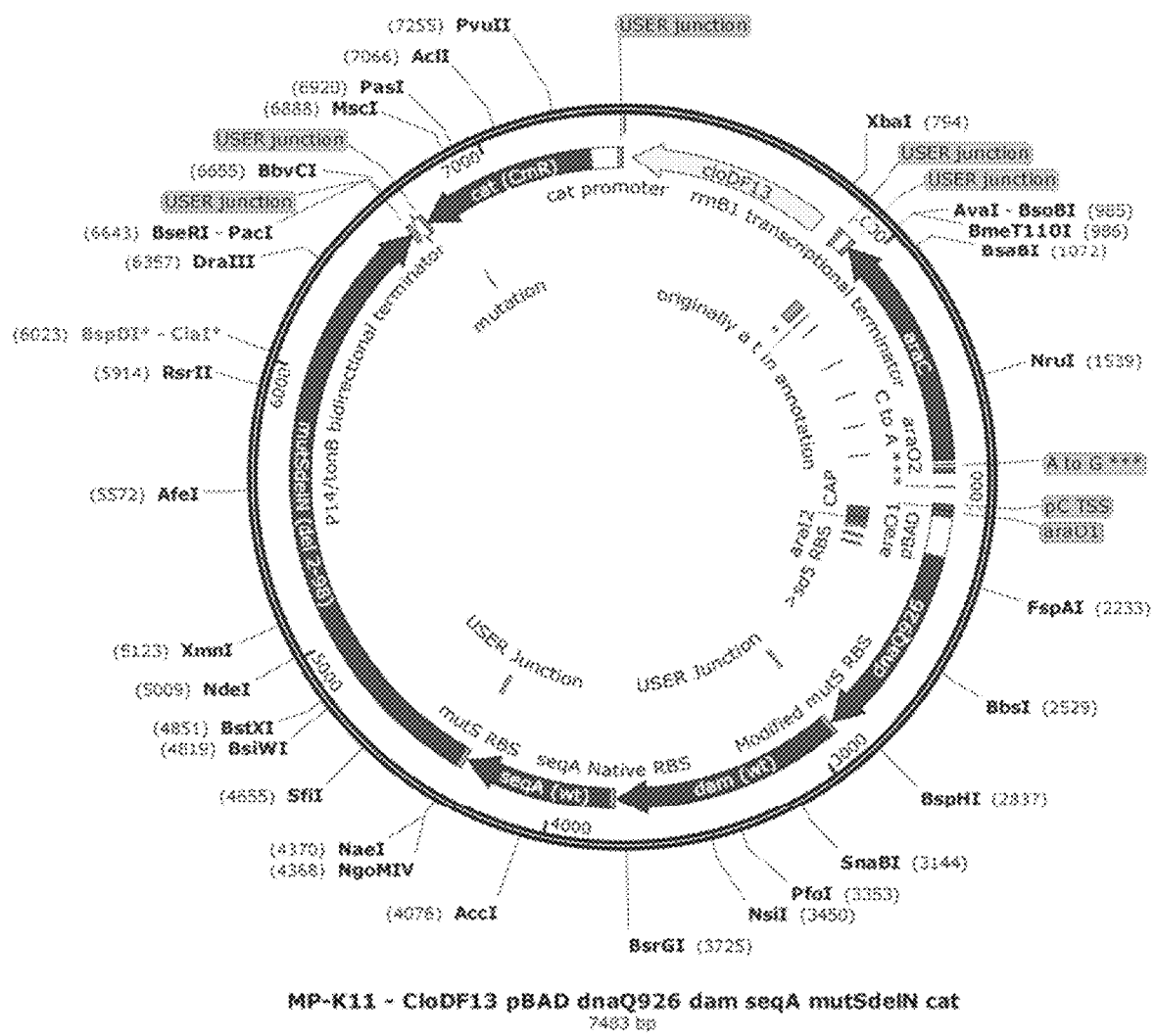
FIG. 54. MP-K11 Vector Map. A schematic depiction of one embodiment of a MP-K11 mutagenesis vector is provided, referenced herein as SEQ ID NO: 71. This embodiment comprises araC, dnaQ926, dam, seqA, and mutSdeIN (del 2-98).
Figure 55:
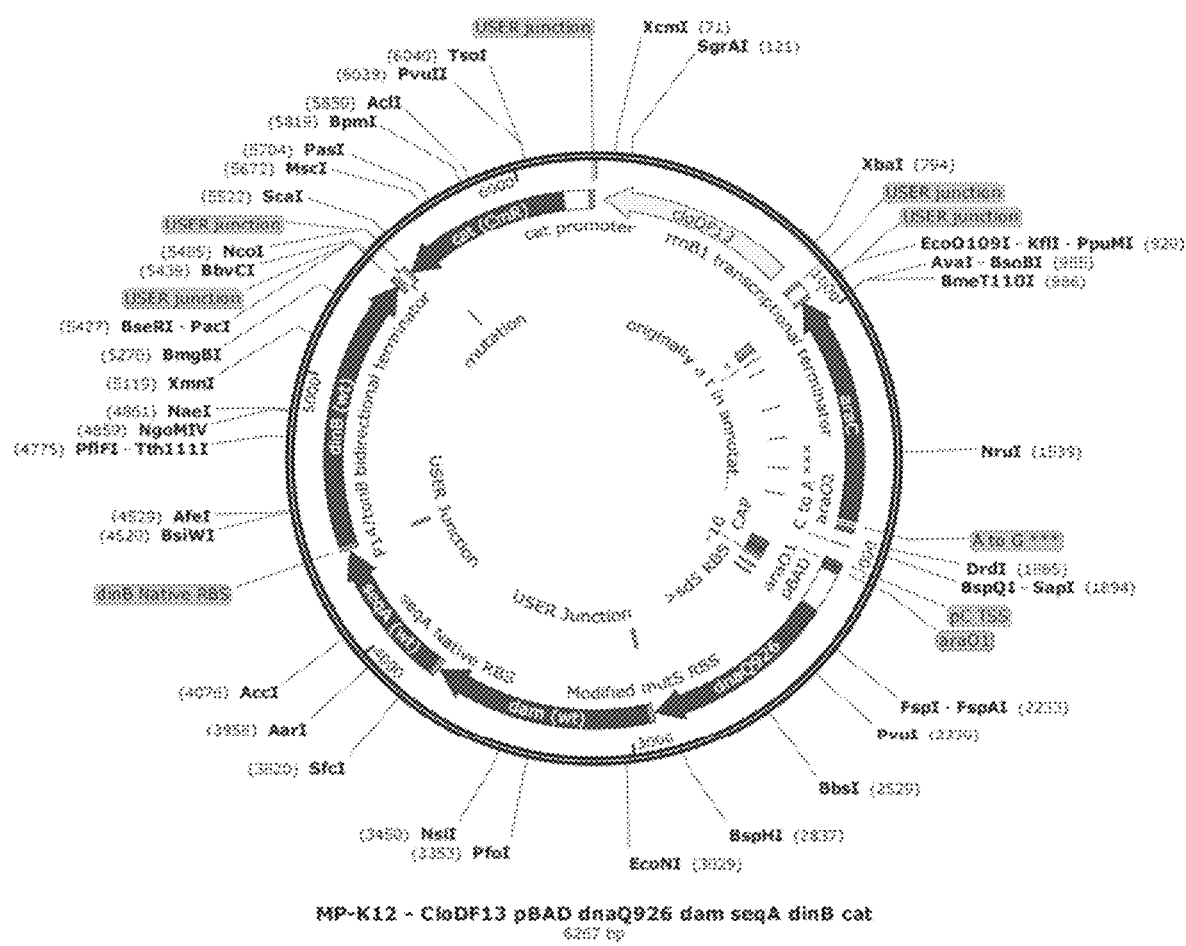
FIG. 55. MP-K12 Vector Map. A schematic depiction of one embodiment of a MP-K12 mutagenesis vector is provided, referenced herein as SEQ ID NO: 72. This embodiment comprises araC, dnaQ926, dam, seqA, and dinB.
Figure 56:
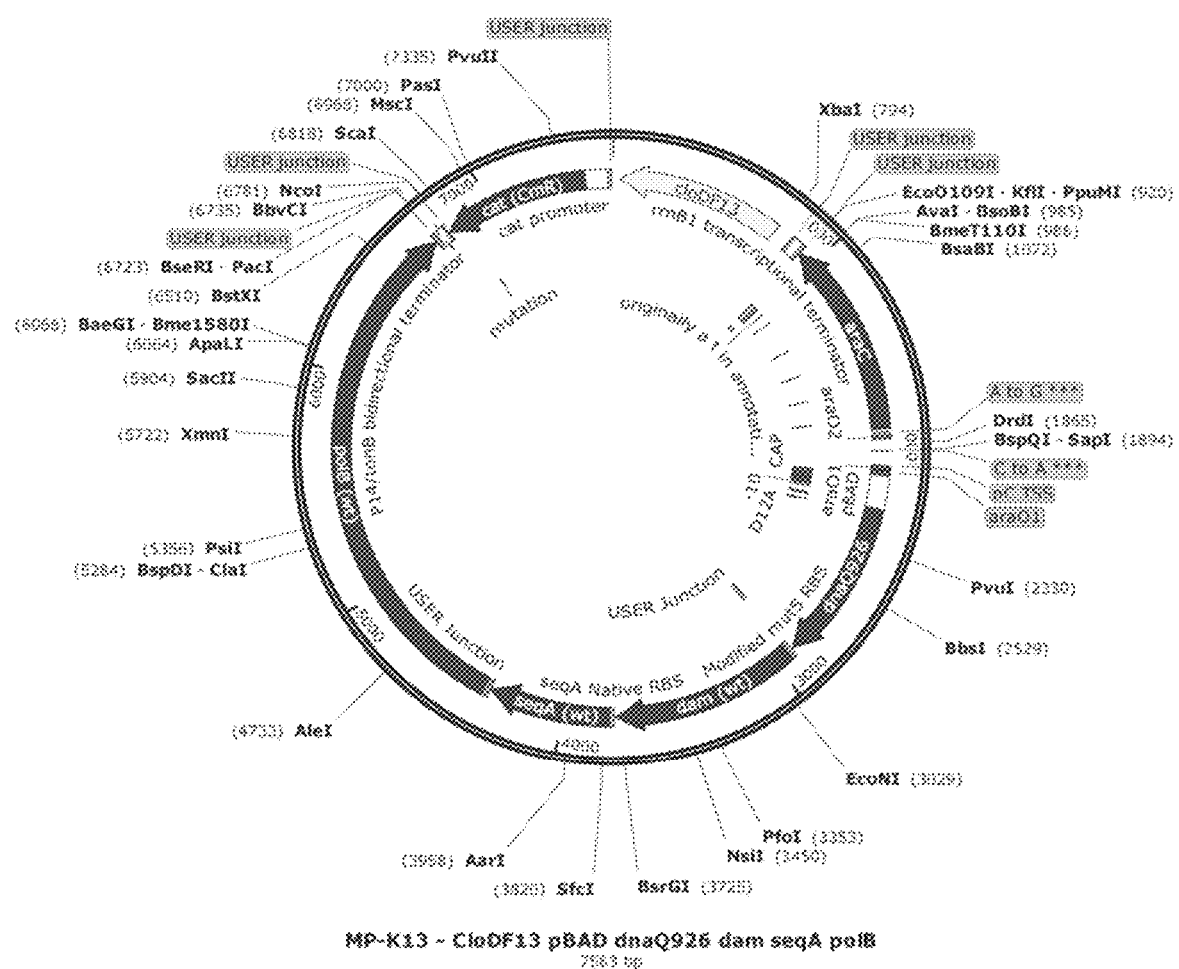
FIG. 56. MP-K13 Vector Map. A schematic depiction of one embodiment of a MP-K13 mutagenesis vector is provided, referenced herein as SEQ ID NO: 73. This embodiment comprises araC, dnaQ926, dam, seqA, and polB.
Figure 57:
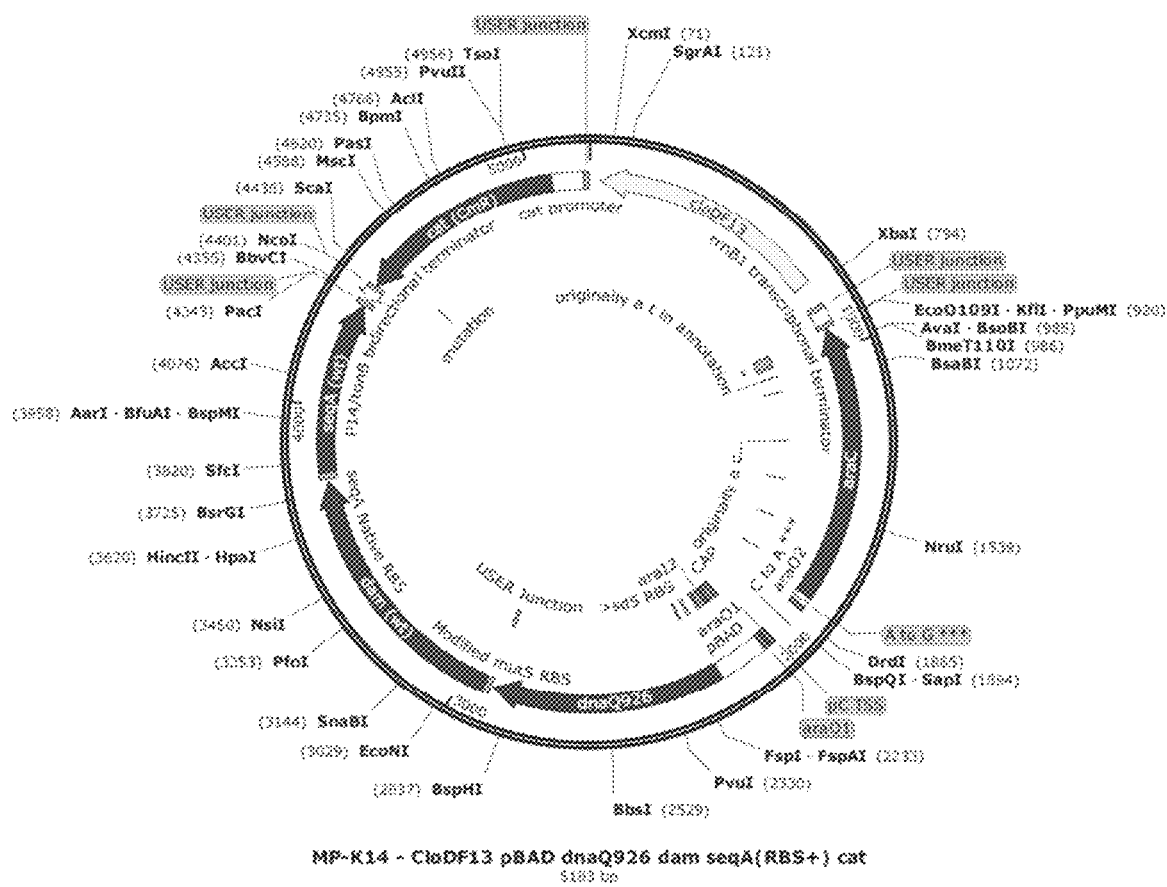
FIG. 57. MP-K14 Vector Map. A schematic depiction of one embodiment of a MP-K14 mutagenesis vector is provided, referenced herein as SEQ ID NO: 74. This embodiment comprises araC, dnaQ926, dam, and seqA (RBS+).
Figure 58:
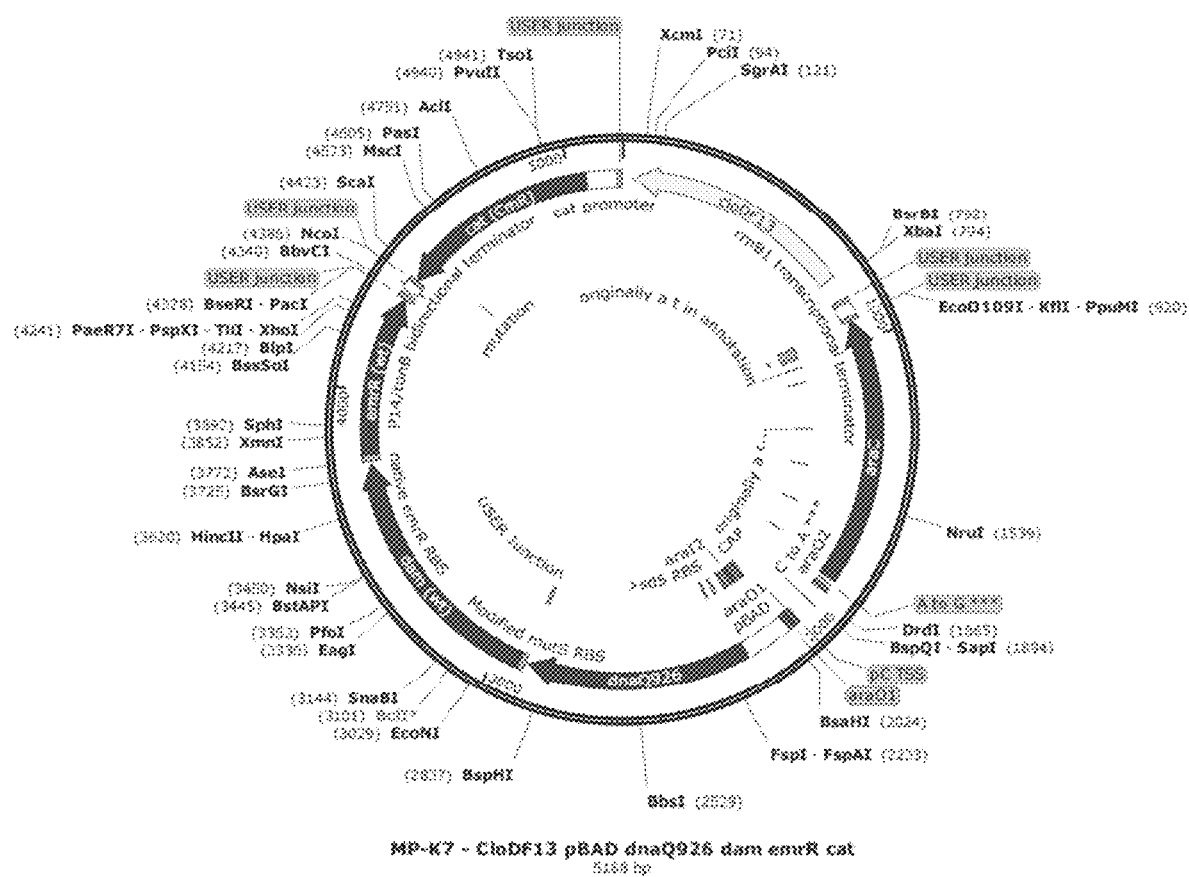
FIG. 58. MP-K7 Vector Map. A schematic depiction of one embodiment of a MP-K7 mutagenesis vector is provided, referenced herein as SEQ ID NO: 75. This embodiment comprises araC, dnaQ926, dam, and emrR.
Figure 59:
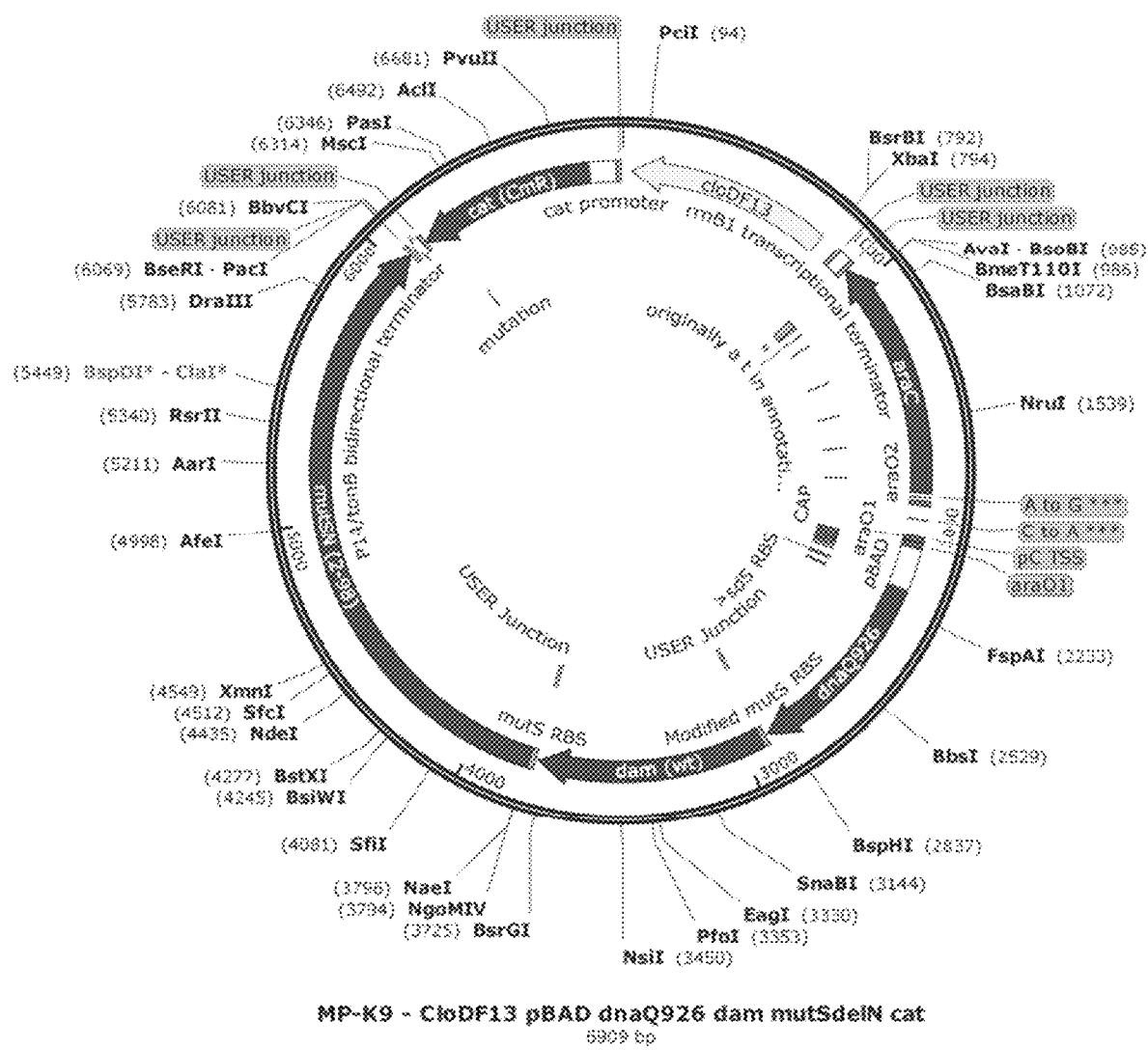
FIG. 59. MP-K9 Vector Map. A schematic depiction of one embodiment of a MP-K9 mutagenesis vector is provided, referenced herein as SEQ ID NO: 76. This embodiment comprises araC, dnaQ926, dam, and mutSdeIN(2-98).
Figure 60:
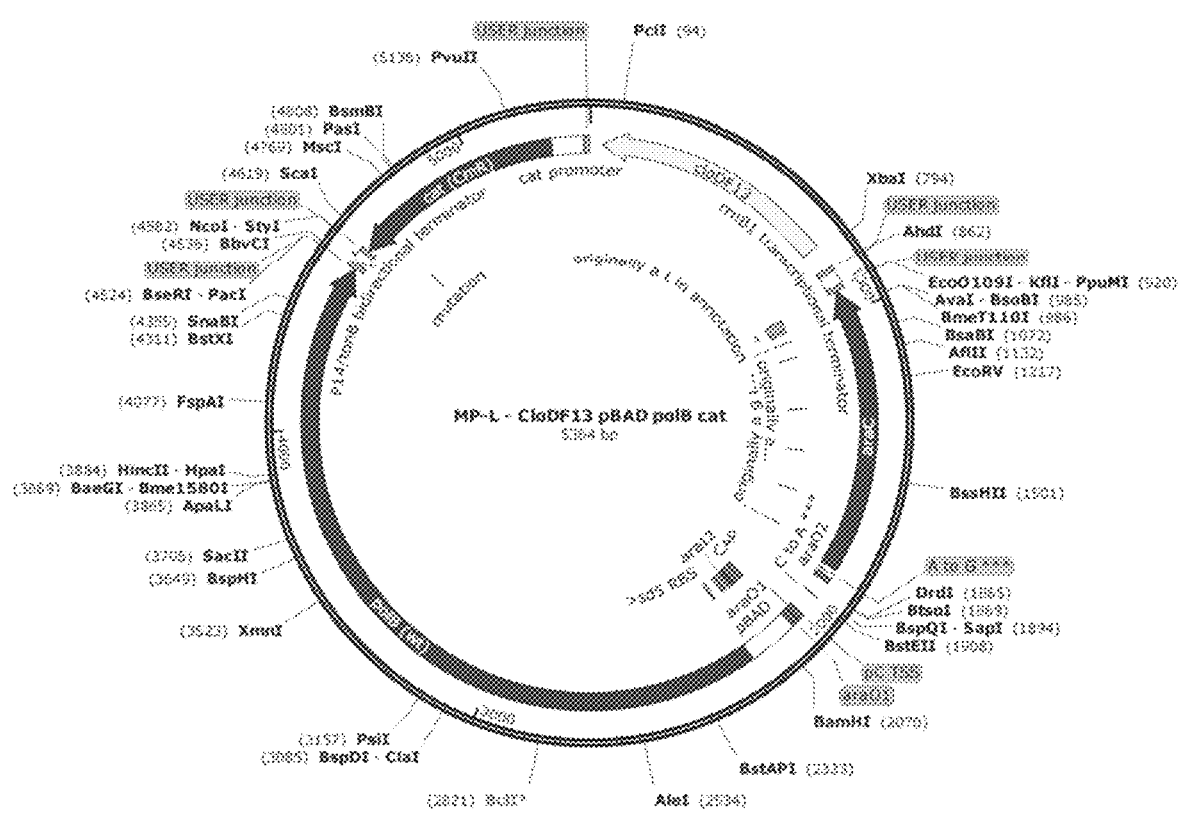
FIG. 60. MP-L Vector Map. A schematic depiction of one embodiment of a MP-L mutagenesis vector is provided, referenced herein as SEQ ID NO: 77. This embodiment comprises araC, and polB.
Figure 61:
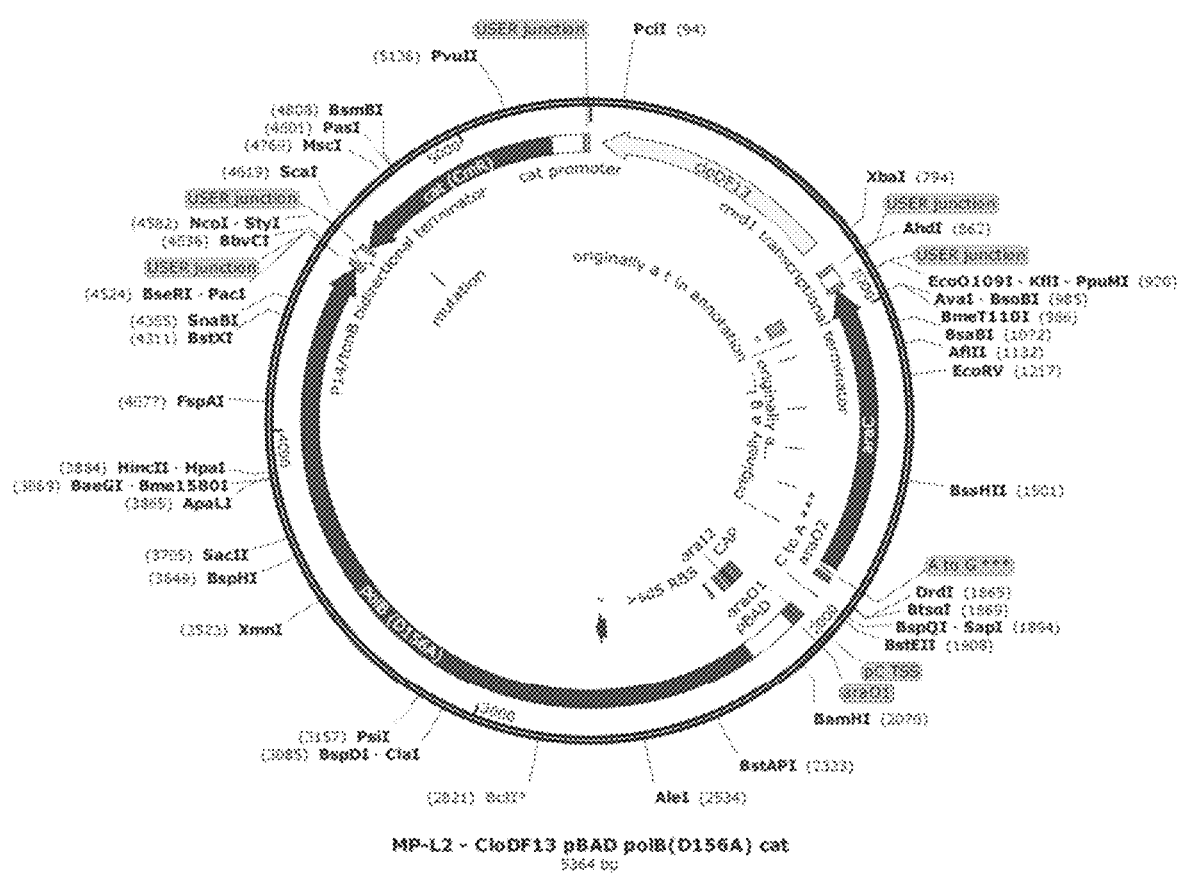
FIG. 61. MP-L2 Vector Map. A schematic depiction of one embodiment of a MP-L2 mutagenesis vector is provided, referenced herein as SEQ ID NO: 78. This embodiment comprises araC, and polB(D156A).
Figure 62:
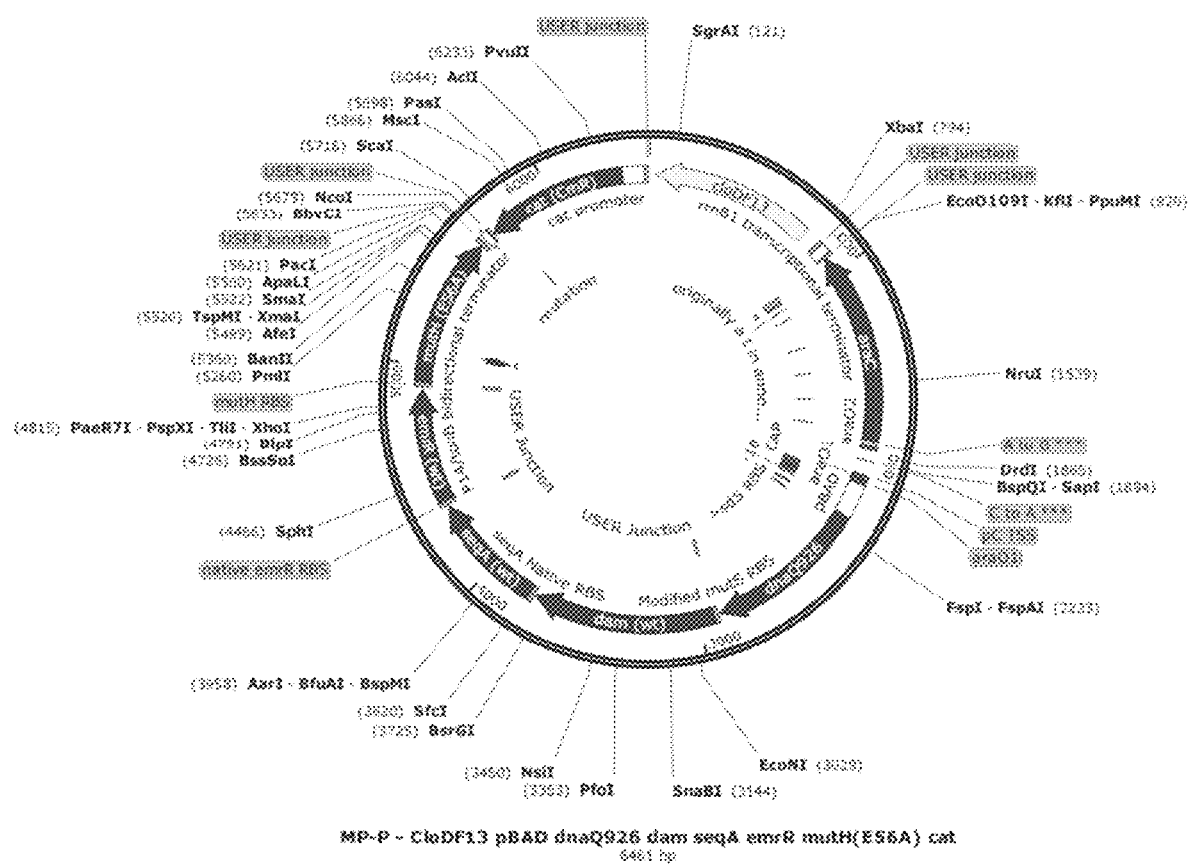
FIG. 62. MP-P Vector Map. A schematic depiction of one embodiment of a MP-P mutagenesis vector is provided, referenced herein as SEQ ID NO: 79. This embodiment comprises araC, dnaQ926, dam, seqA, emrR, and mutH (E56A).
Figure 63:
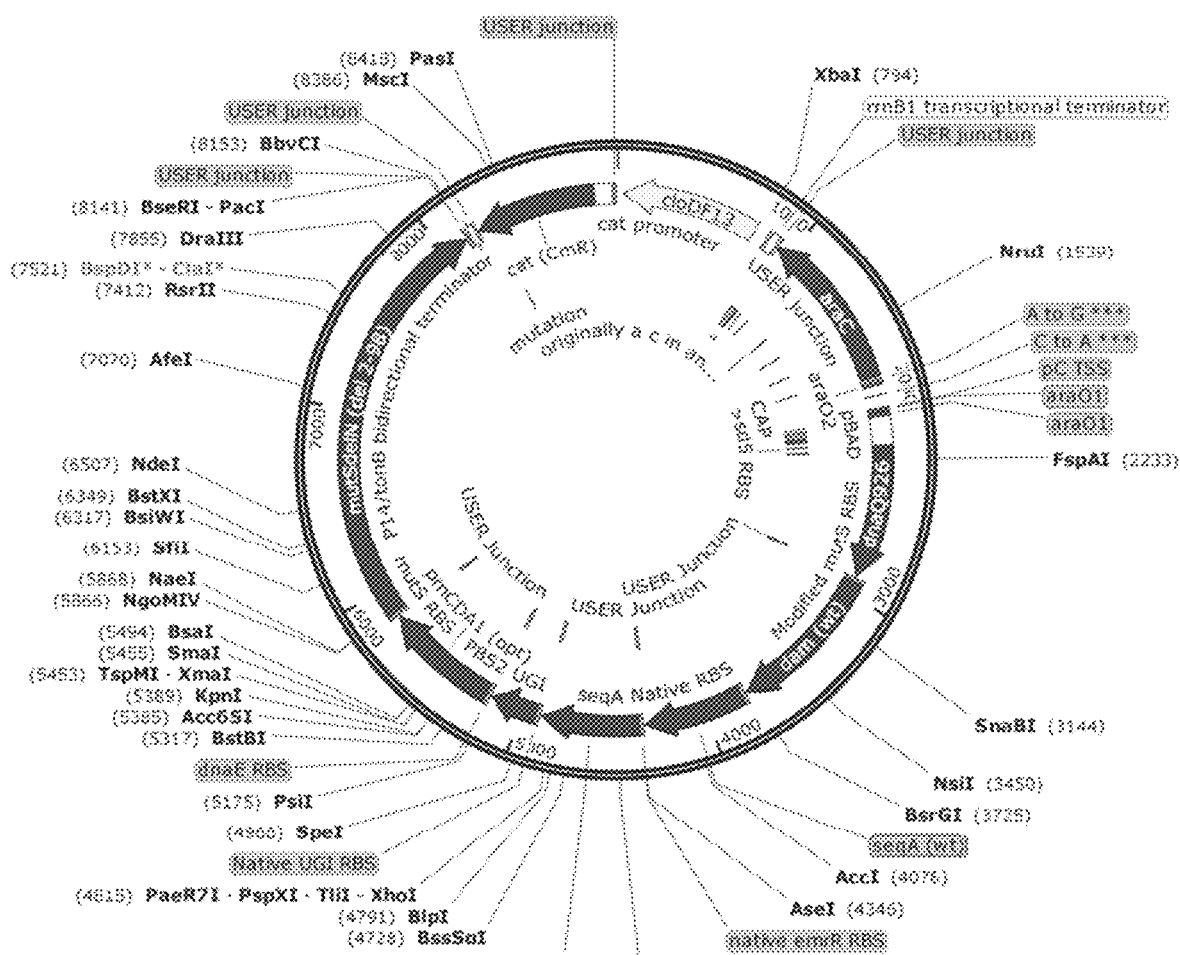
FIG. 63. MP-P11 Vector Map. A schematic depiction of one embodiment of a MP-P11 mutagenesis vector is provided, referenced herein as SEQ ID NO: 80. This embodiment comprises araC, dnaQ926, dam, seqA, emrR, ugi and pmCDA1, mutSdeIN(del-29).
Figure 64:
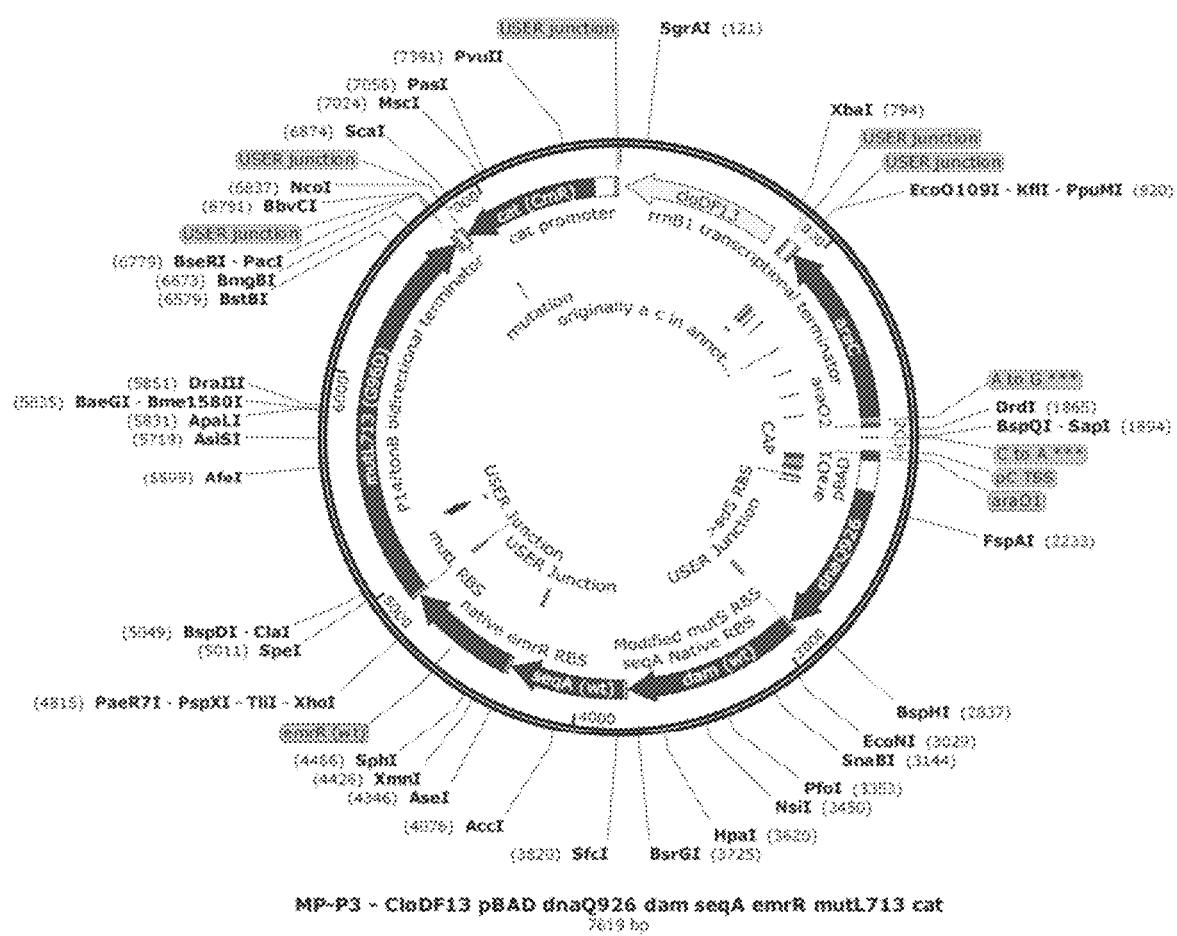
FIG. 64. MP-P3 Vector Map. A schematic depiction of one embodiment of a MP-P3 mutagenesis vector is provided, referenced herein as SEQ ID NO: 81. This embodiment comprises araC, dnaQ926, dam, seqA, emrR, and mutL713.
Figure 65:
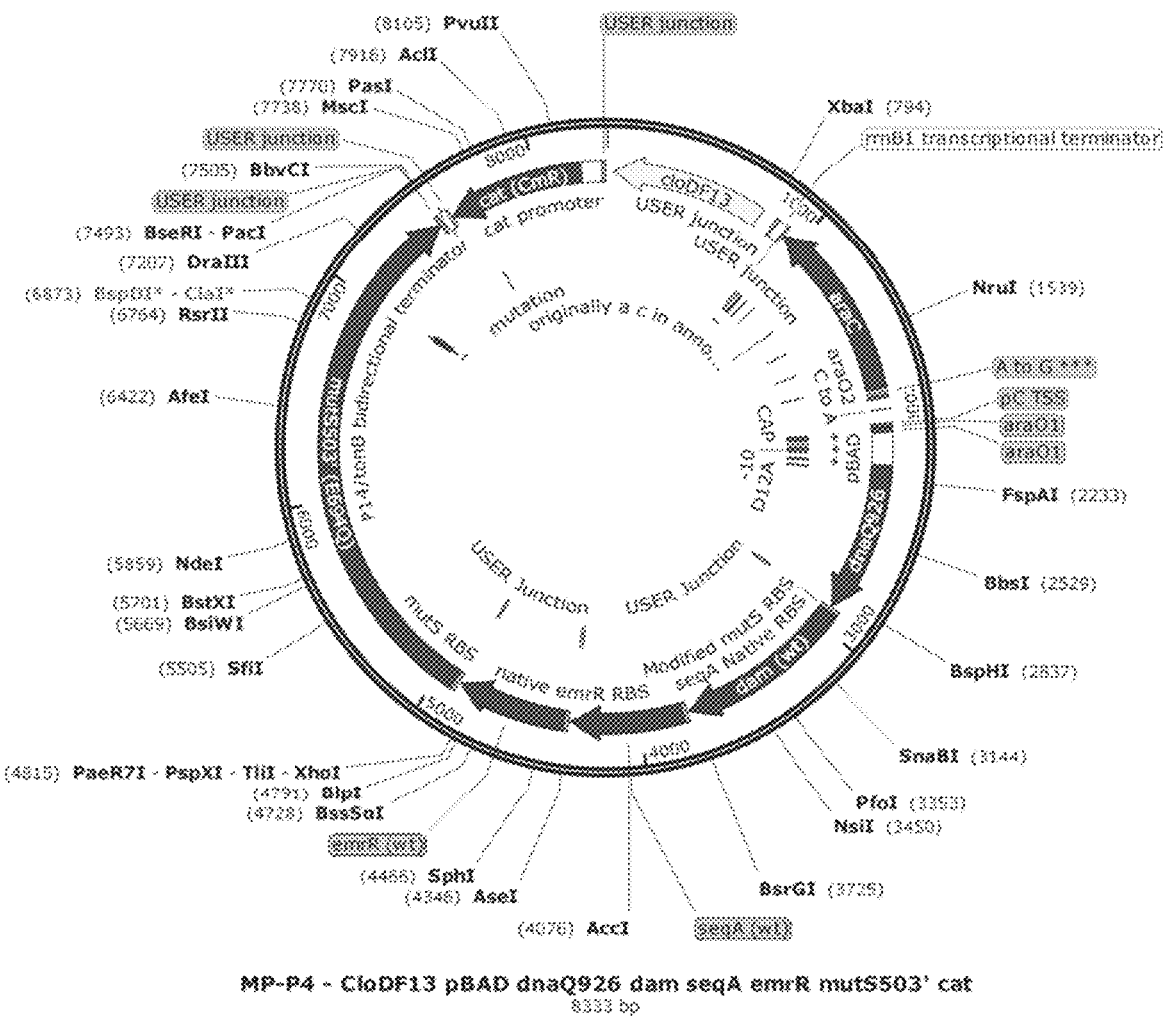
FIG. 65. MP-P4 Vector Map. A schematic depiction of one embodiment of a MP-P4 mutagenesis vector is provided, referenced herein as SEQ ID NO: 82. This embodiment comprises araC, dnaQ926, dam, seqA, emrR, and mutS503'.
Figure 66:
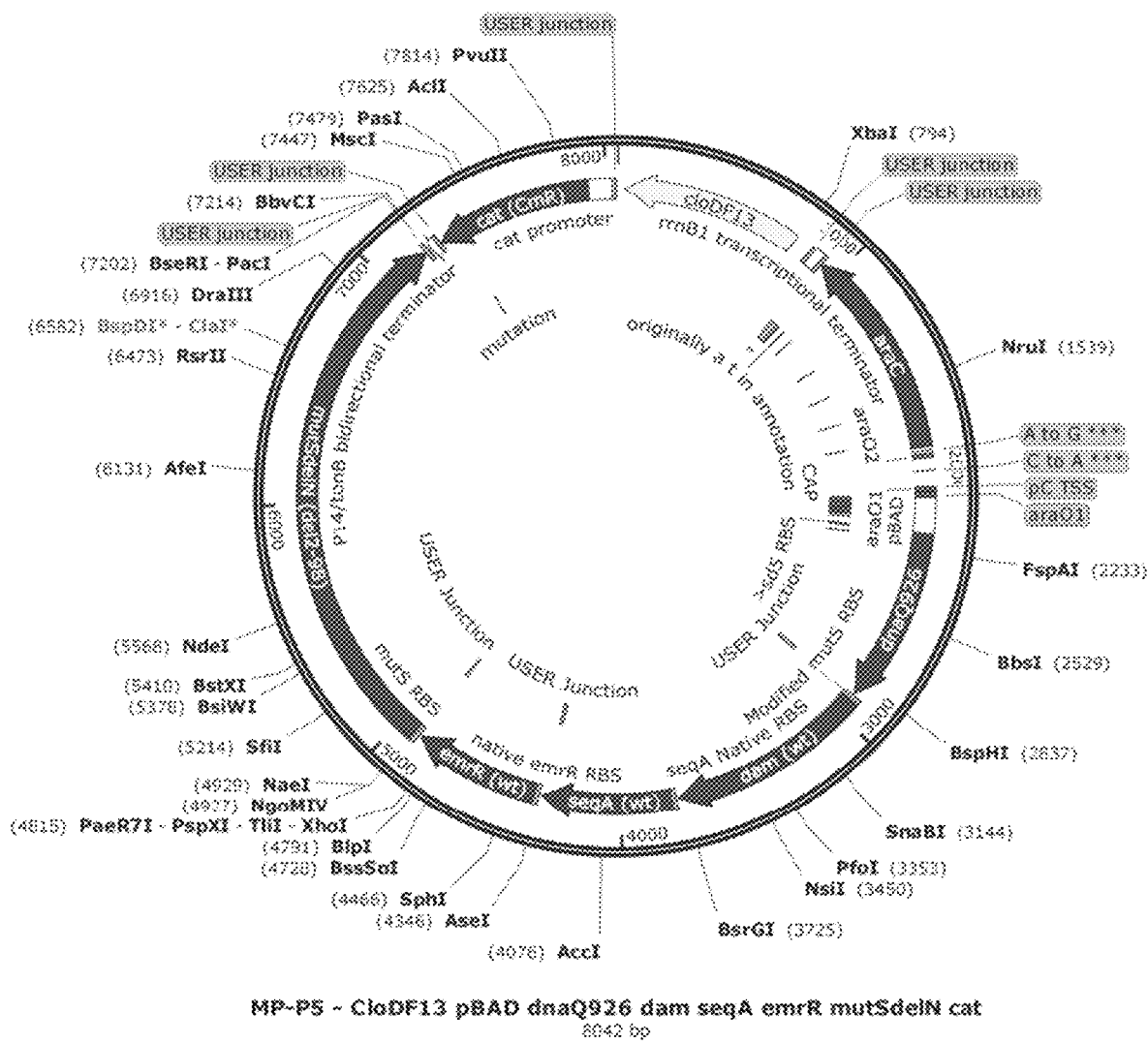
FIG. 66. MP-P5 Vector Map. A schematic depiction of one embodiment of a MP-P5 mutagenesis vector is provided, referenced herein as SEQ ID NO: 83. This embodiment comprises araC, dnaQ926, dam, seqA, emrR, and mutSdeIN(del 2-98).
Figure 67:
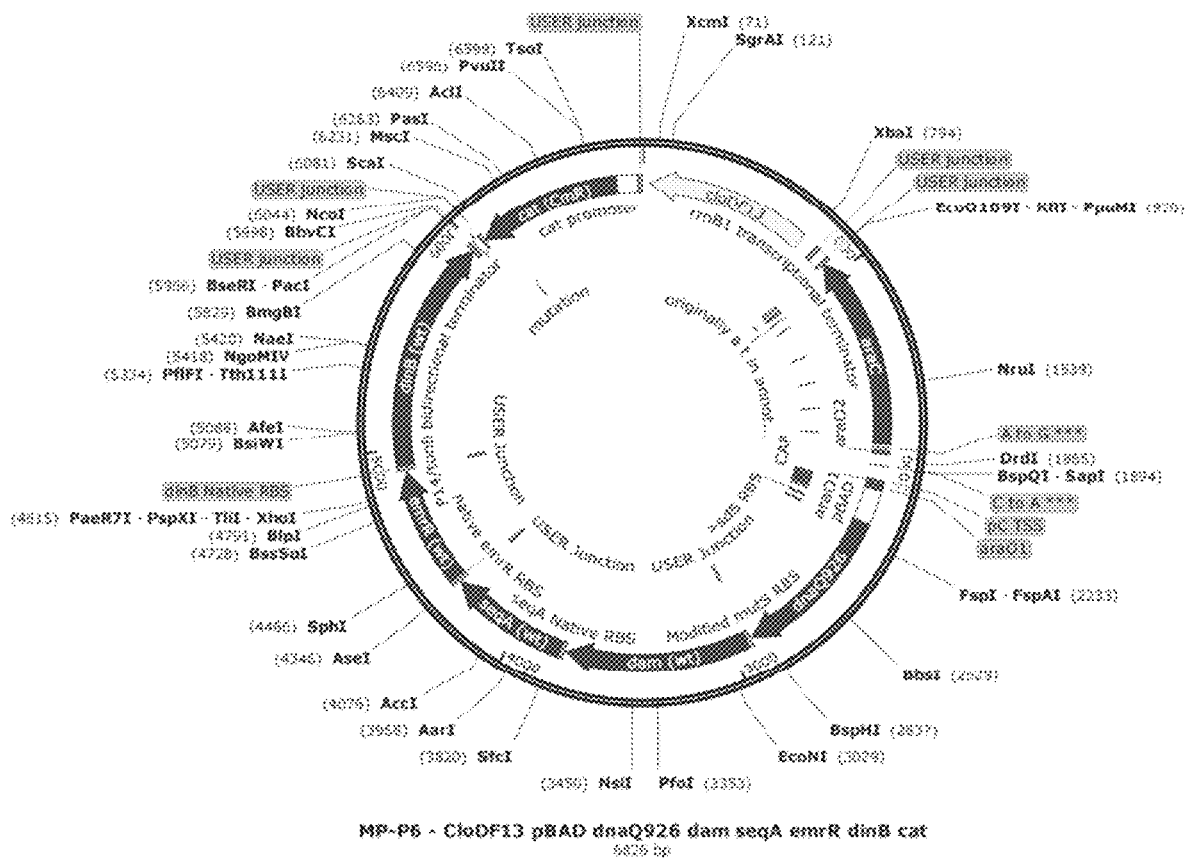
FIG. 67. MP-P6 Vector Map. A schematic depiction of one embodiment of a MP-P6 mutagenesis vector is provided, referenced herein as SEQ ID NO: 84. This embodiment comprises araC, dnaQ926, dam, seqA, emrR, and dinB.
Figure 68:
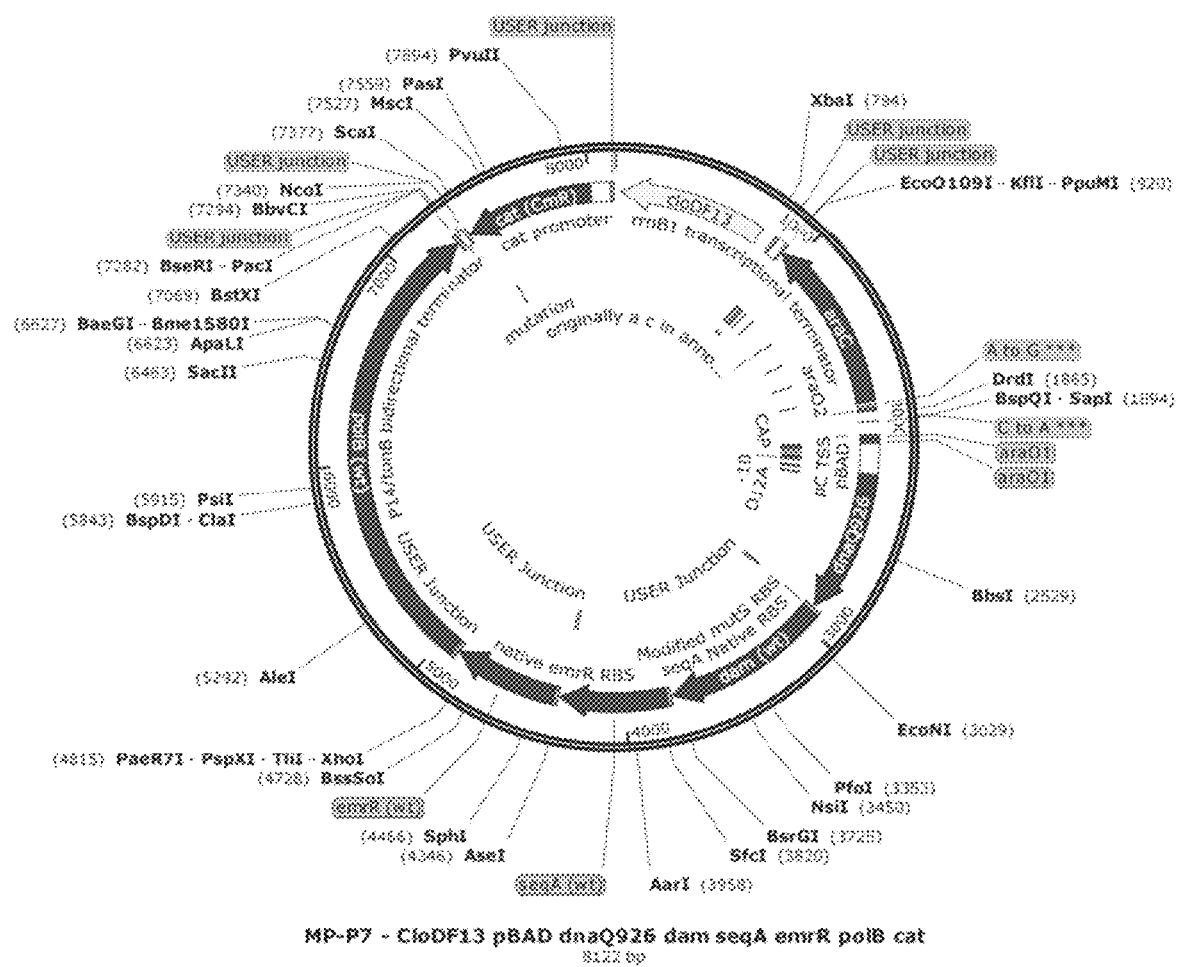
FIG. 68. MP-P7 Vector Map. A schematic depiction of one embodiment of a MP-P7 mutagenesis vector is provided, referenced herein as SEQ ID NO: 85. This embodiment comprises araC, dnaQ926, dam, seqA, emrR, and polB.
Figure 69:
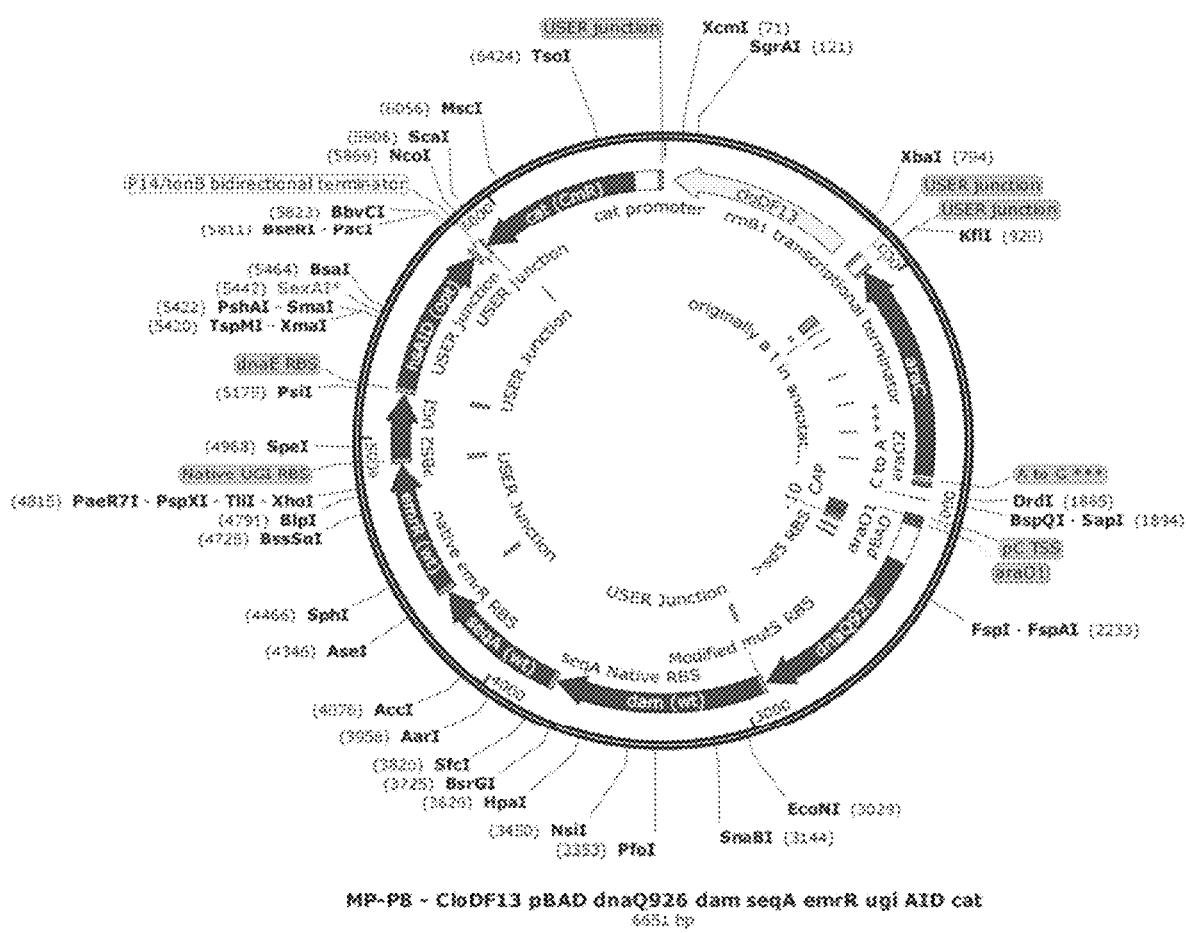
FIG. 69. MP-P8 Vector Map. A schematic depiction of one embodiment of a MP-P8 mutagenesis vector is provided, referenced herein as SEQ ID NO: 86. This embodiment comprises araC, dnaQ926, dam, seqA, emrR, ugi and hsAID.
Figure 70:
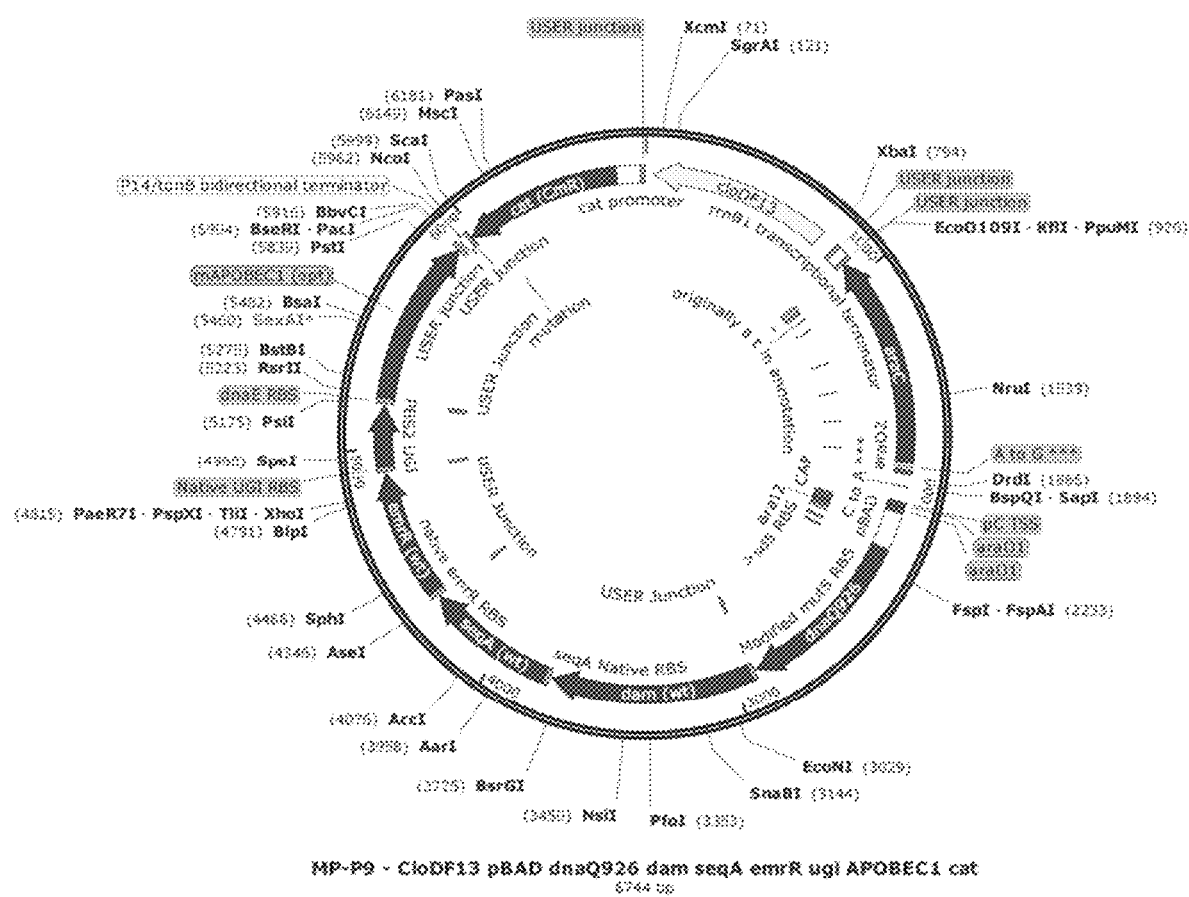
FIG. 70. MP-P9 Vector Map. A schematic depiction of one embodiment of a MP-P9 mutagenesis vector is provided, referenced herein as SEQ ID NO: 87. This embodiment comprises araC, dnaQ926, dam, seqA, emrR, ugi and mAPOBEC1.
Figure 71:
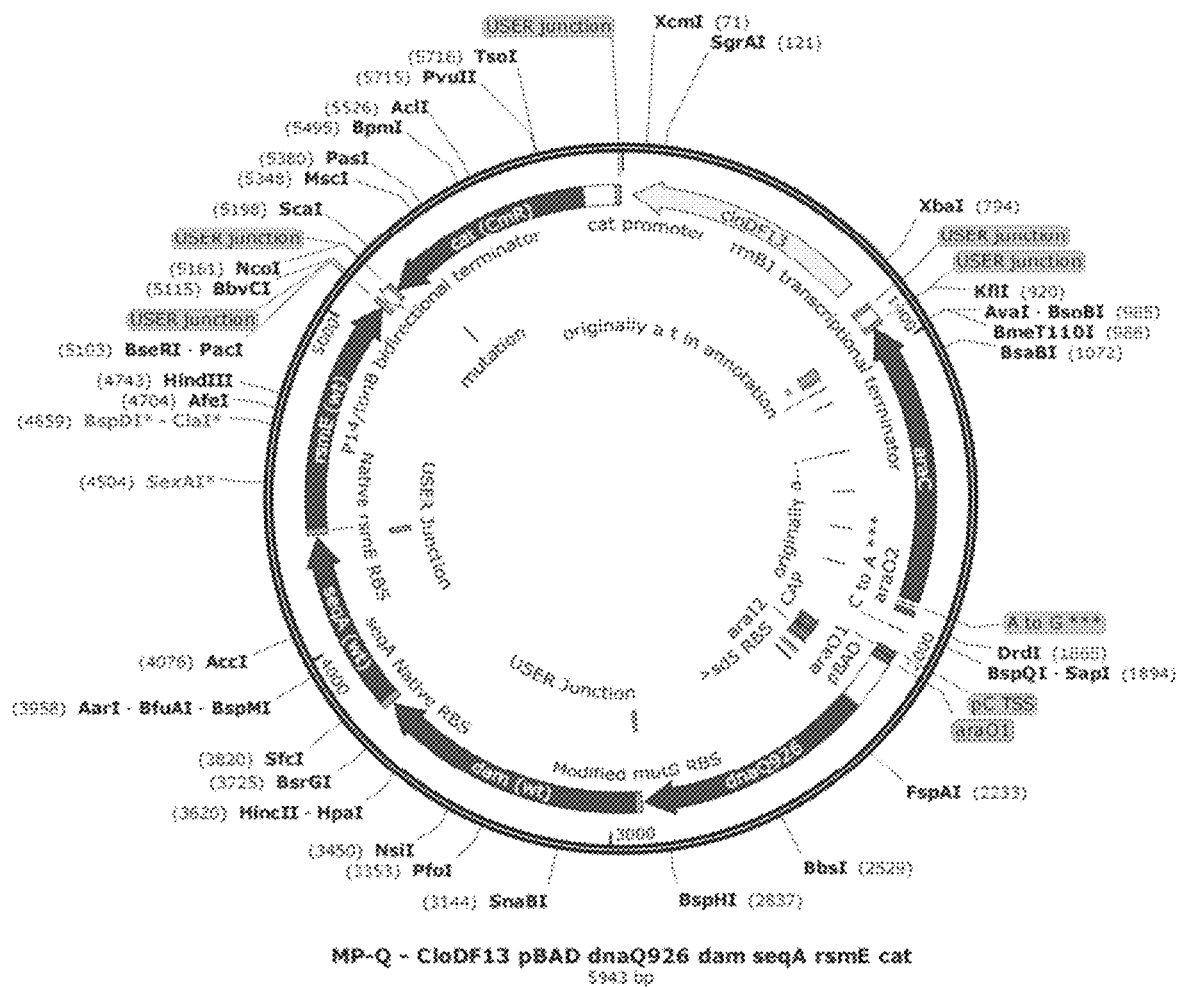
FIG. 71. MP-Q Vector Map. A schematic depiction of one embodiment of a MP-Q mutagenesis vector is provided, referenced herein as SEQ ID NO: 88. This embodiment comprises araC, dnaQ926, dam, seqA, and rsmE.
Figure 72:
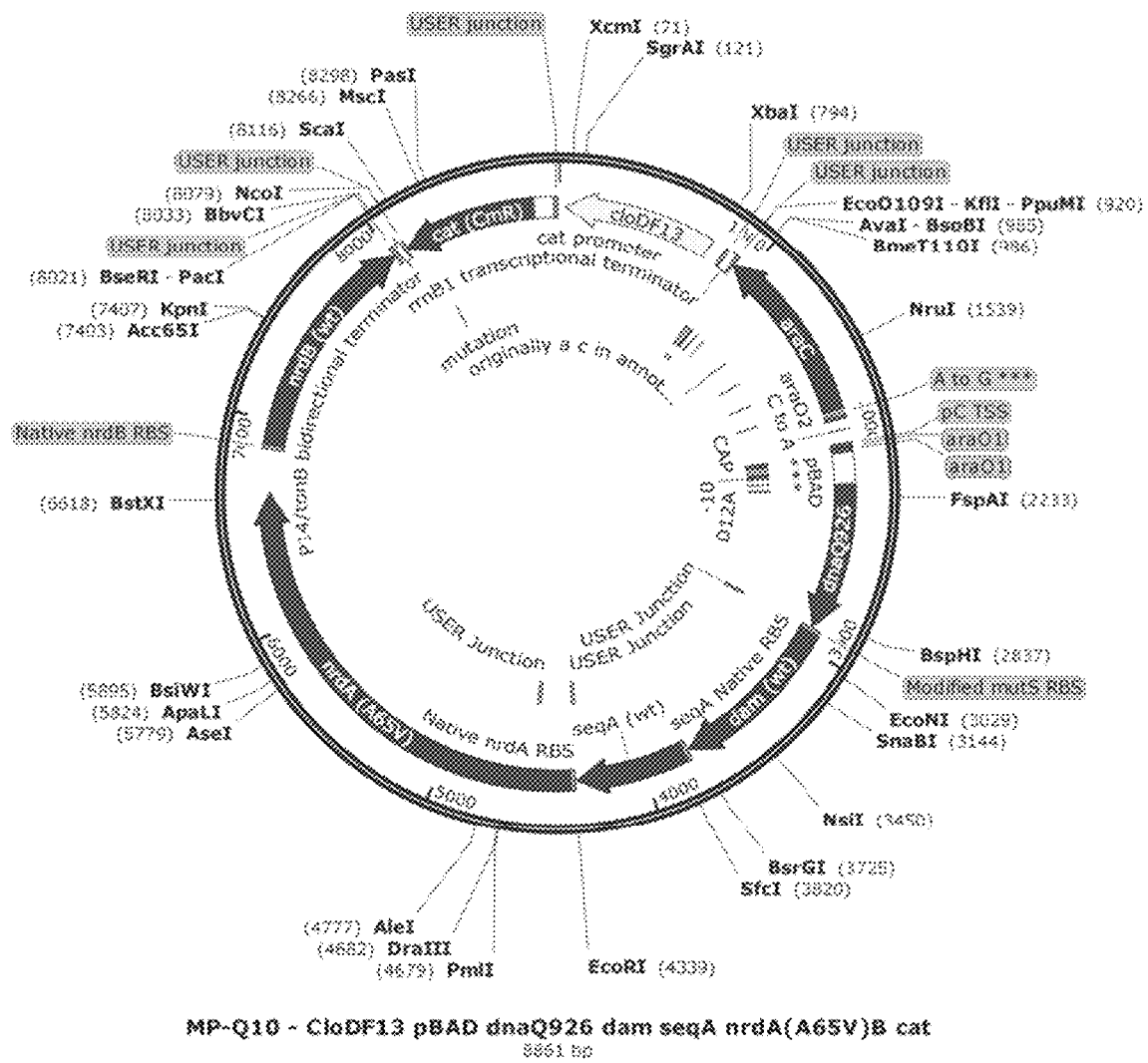
FIG. 72. MP-Q10 Vector Map. A schematic depiction of one embodiment of a MP-Q10 mutagenesis vector is provided, referenced herein as SEQ ID NO: 89. This embodiment comprises araC, dnaQ926, dam, seqA, and nrdA (A65V)B.
Figure 73:
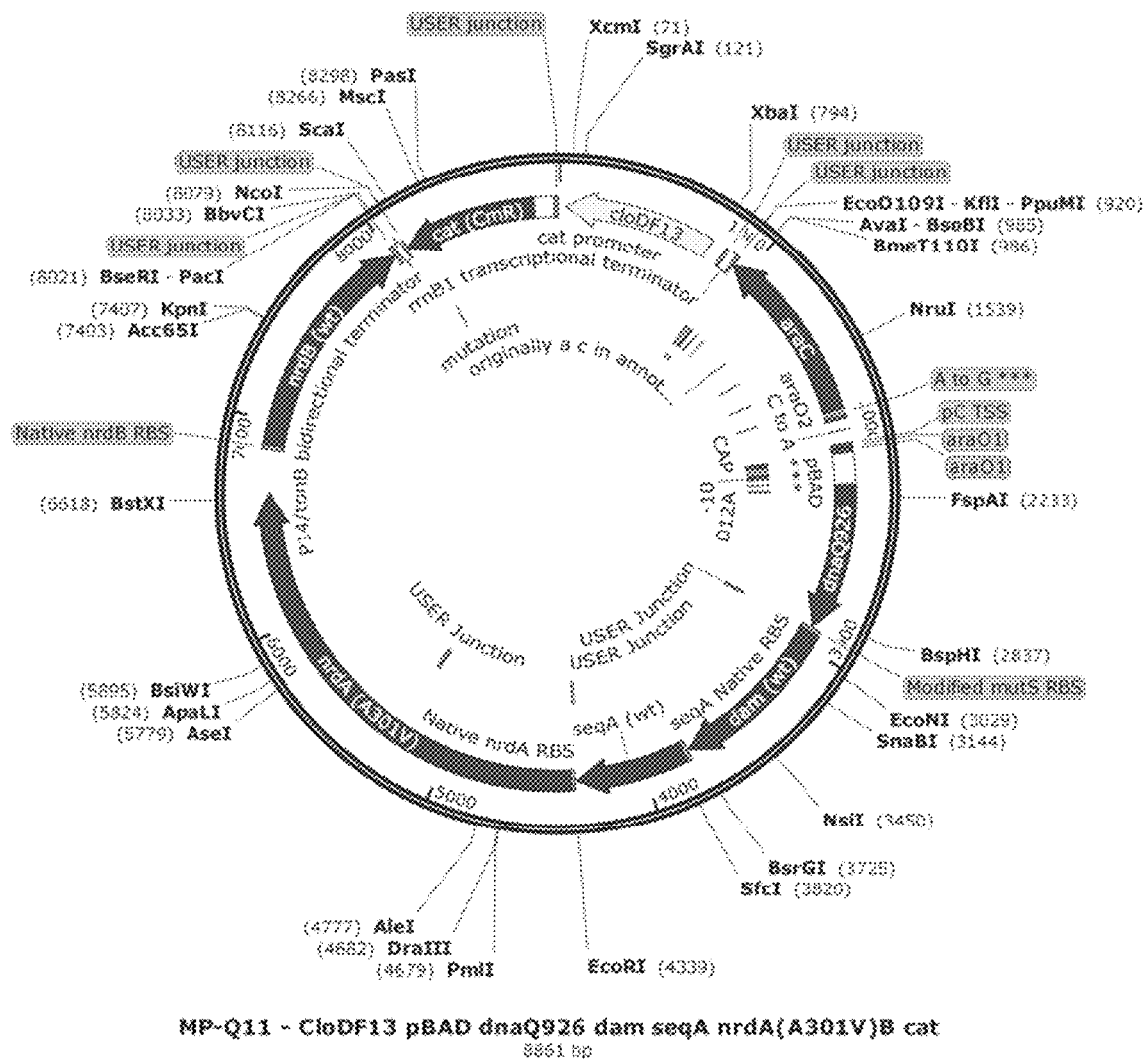
FIG. 73. MP-Q11 Vector Map. A schematic depiction of one embodiment of a MP-Q11 mutagenesis vector is provided, referenced herein as SEQ ID NO: 90. This embodiment comprises araC, dnaQ926, dam, seqA, and nrdA (A301V)B.
Figure 74:
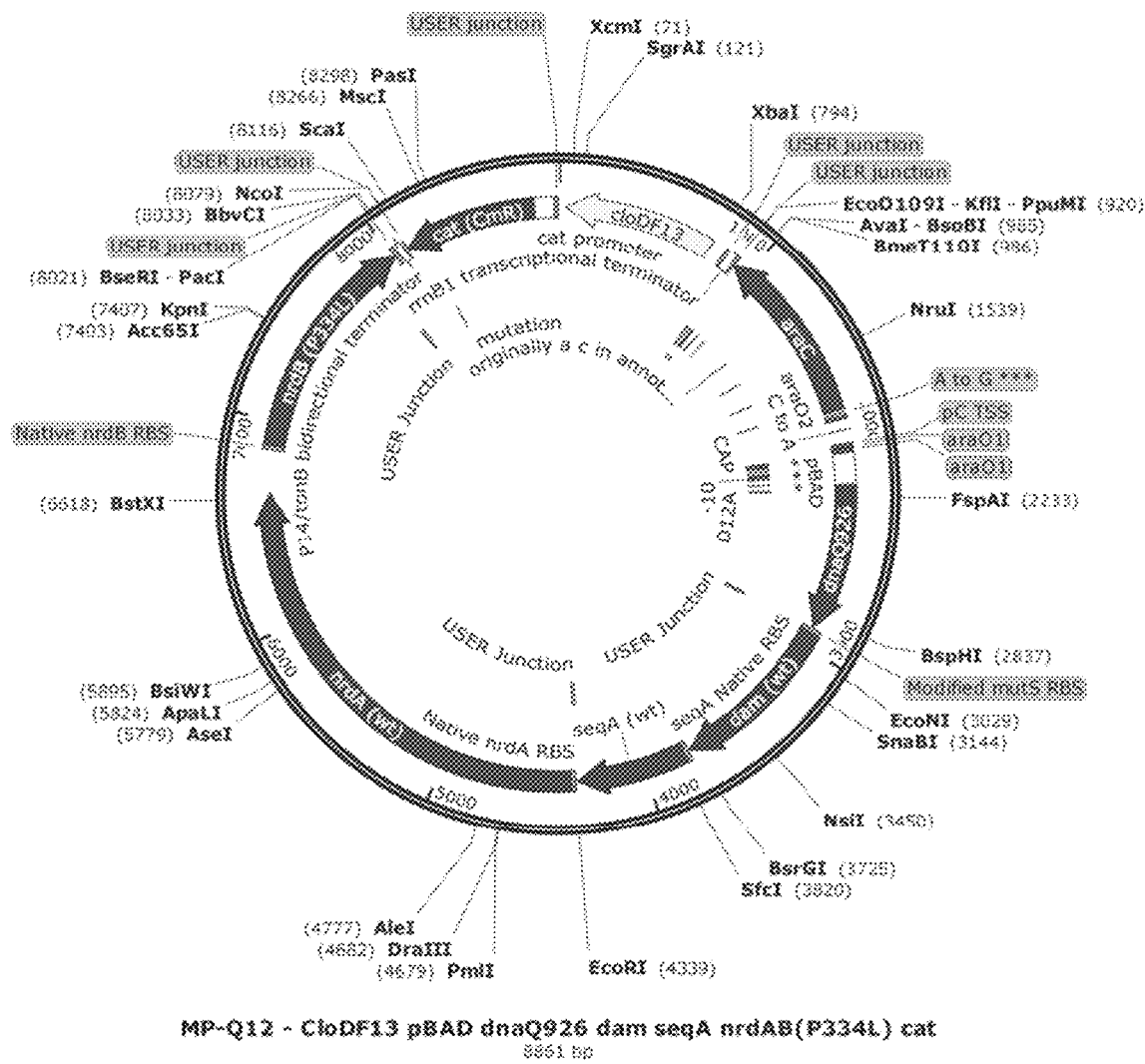
FIG. 74. MP-Q12 Vector Map. A schematic depiction of one embodiment of a MP-Q12 mutagenesis vector is provided, referenced herein as SEQ ID NO: 91. This embodiment comprises araC, dnaQ926, dam, seqA, and nrdAB (P334L).
Figure 75:
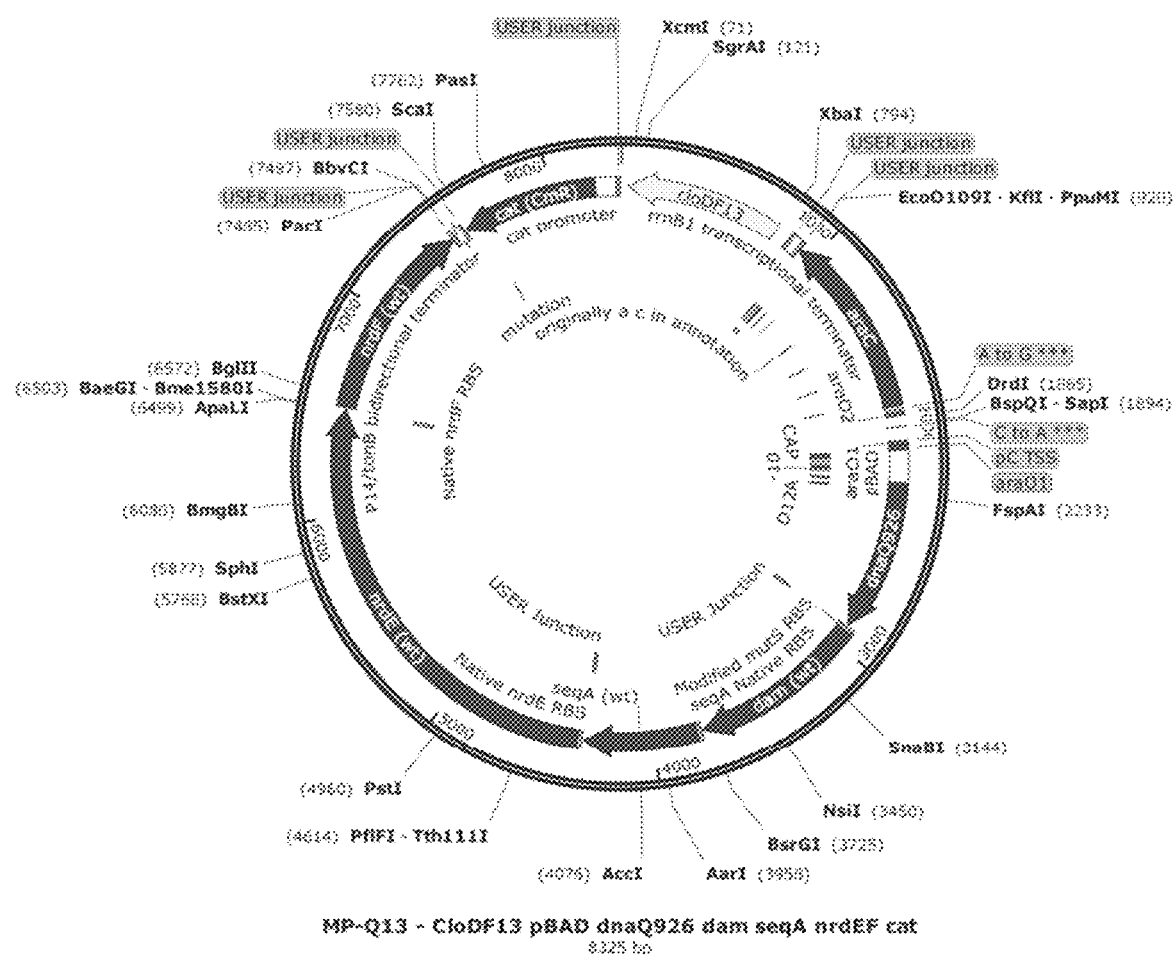
FIG. 75. MP-Q13 Vector Map. A schematic depiction of one embodiment of a MP-Q13 mutagenesis vector is provided, referenced herein as SEQ ID NO: 92. This embodiment comprises araC, dnaQ926, dam, seqA, and nrdEF.
Figure 76:
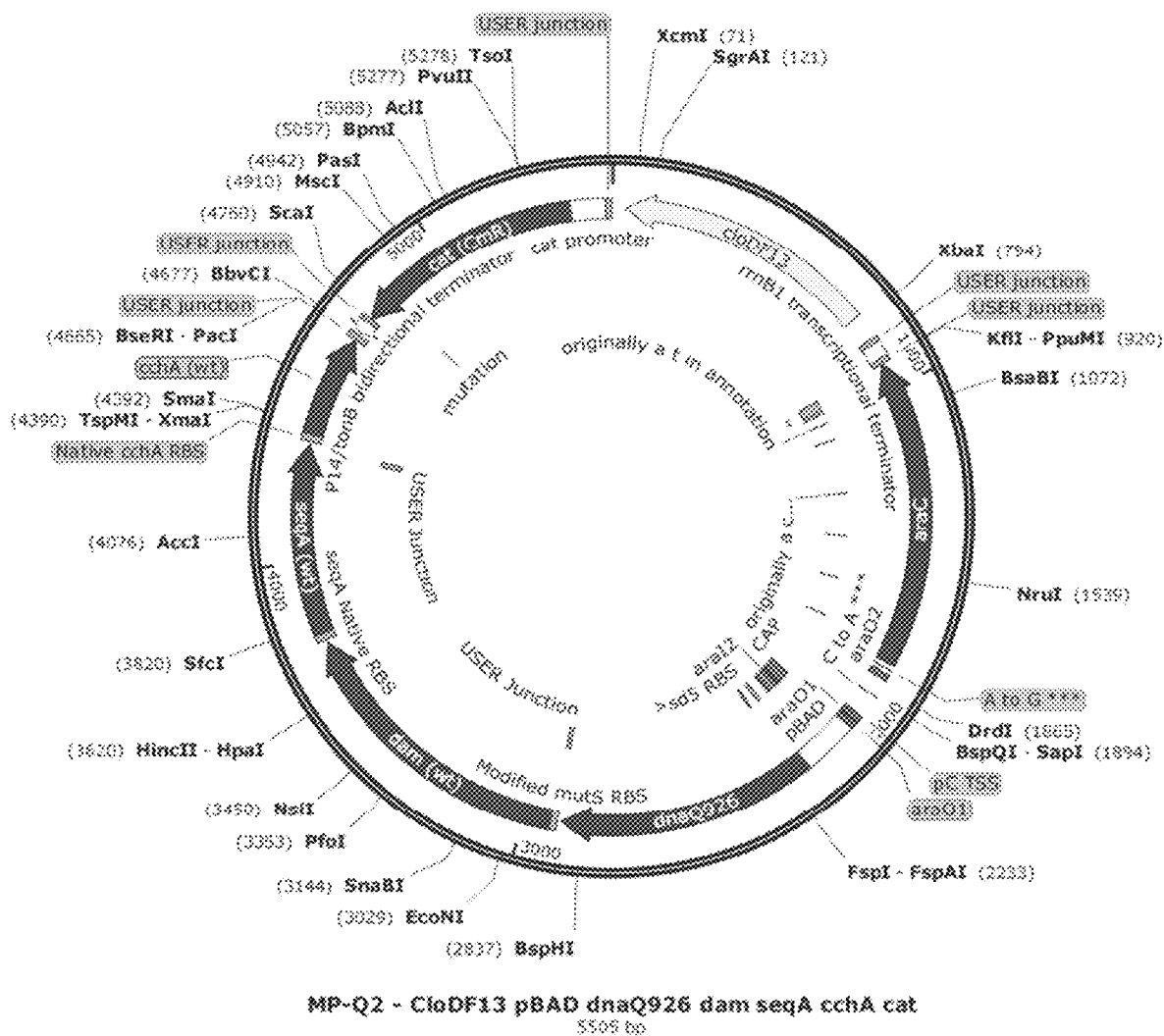
FIG. 76. MP-Q2 Vector Map. A schematic depiction of one embodiment of a MP-Q2 mutagenesis vector is provided, referenced herein as SEQ ID NO: 93. This embodiment comprises araC, dnaQ926, dam, seqA, and cchA.
Figure 77:
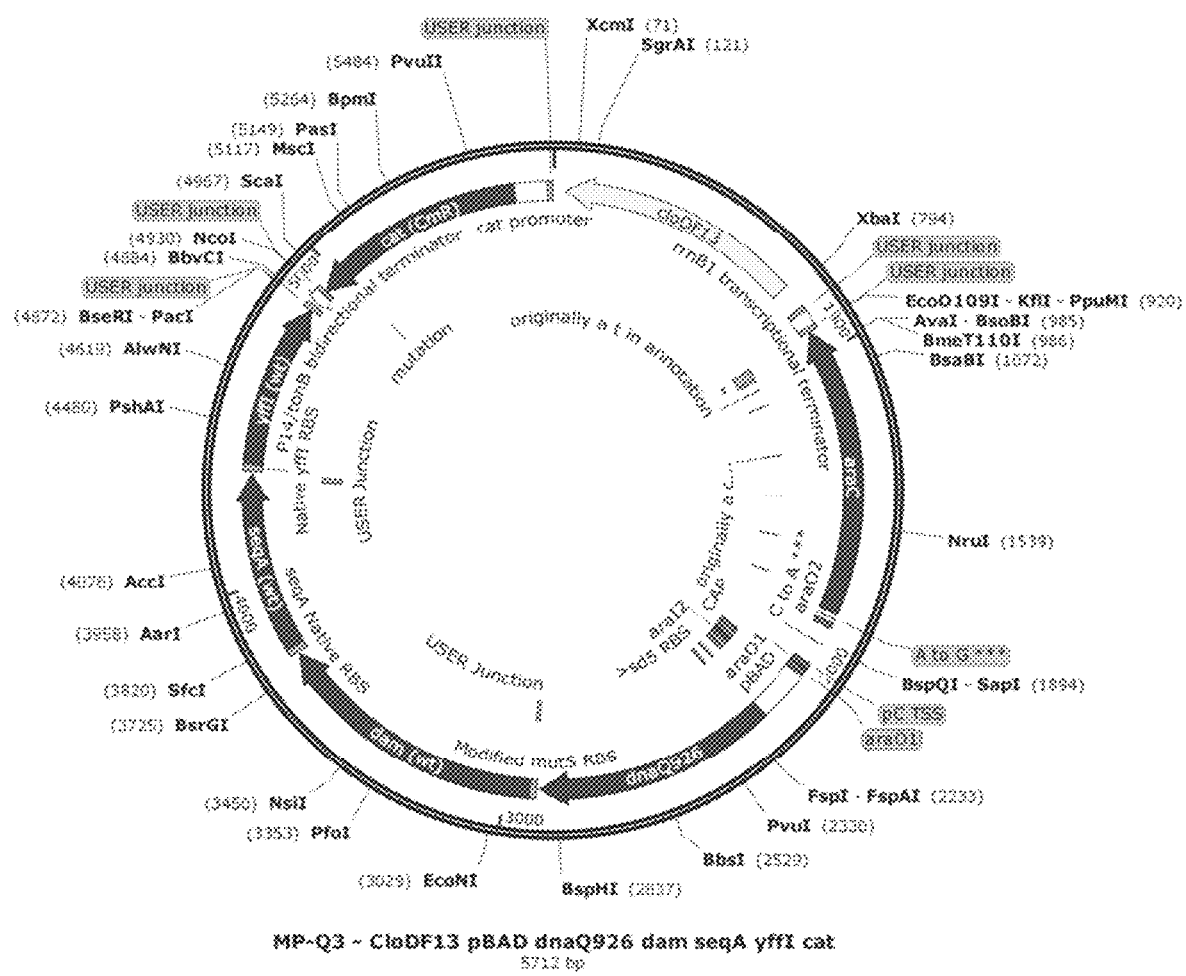
FIG. 77. MP-Q3 Vector Map. A schematic depiction of one embodiment of a MP-Q3 mutagenesis vector is provided, referenced herein as SEQ ID NO: 94. This embodiment comprises araC, dnaQ926, dam, seqA, and yffI.
Figure 78:
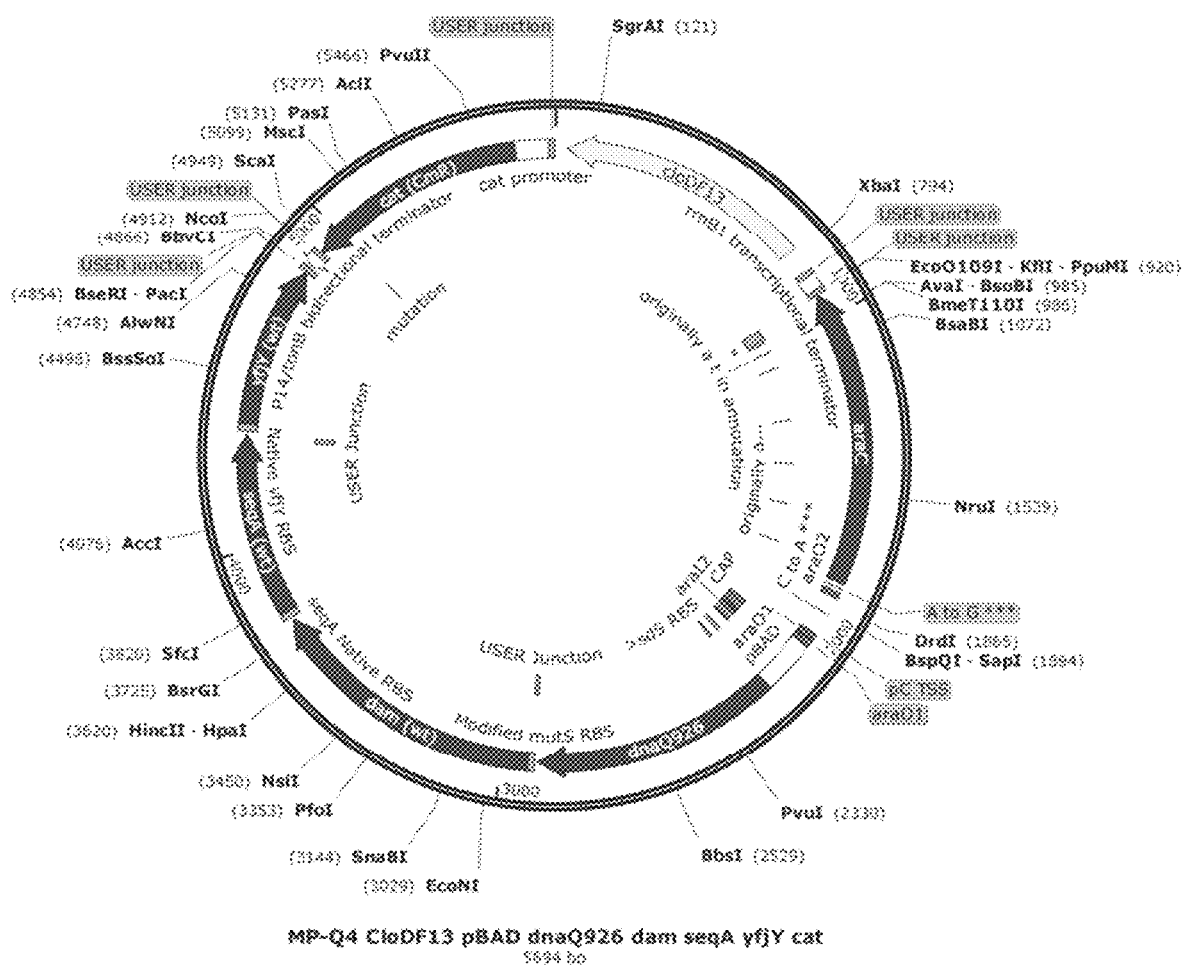
FIG. 78. MP-Q4 Vector Map. A schematic depiction of one embodiment of a MP-Q4 mutagenesis vector is provided, referenced herein as SEQ ID NO: 95. This embodiment comprises araC, dnaQ926, dam, seqA, and yfjY.
Figure 79:
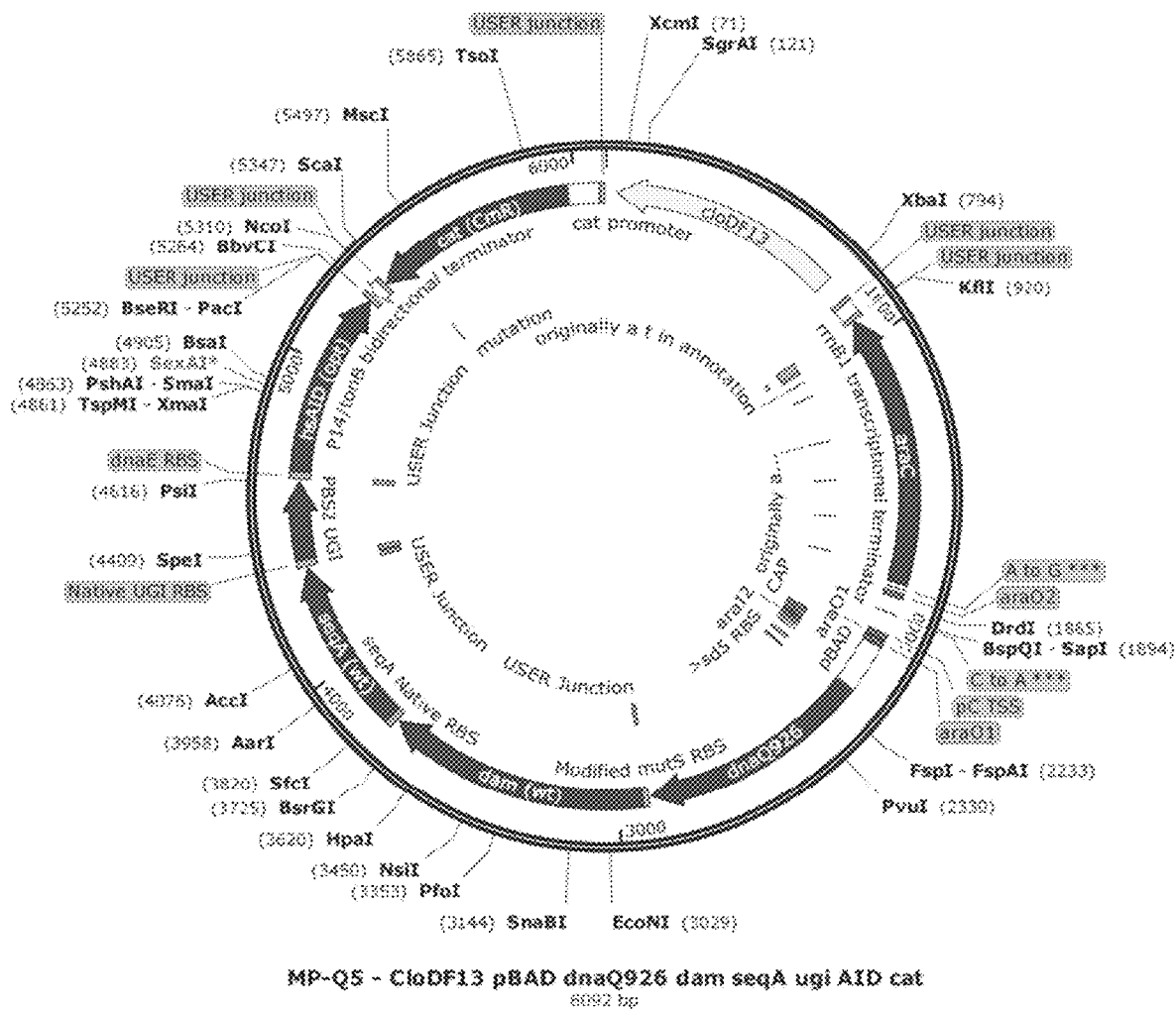
FIG. 79. MP-Q5 Vector Map. A schematic depiction of one embodiment of a MP-Q5 mutagenesis vector is provided, referenced herein as SEQ ID NO: 96. This embodiment comprises araC, dnaQ926, dam, seqA, ugi and hsAID.
Figure 80:
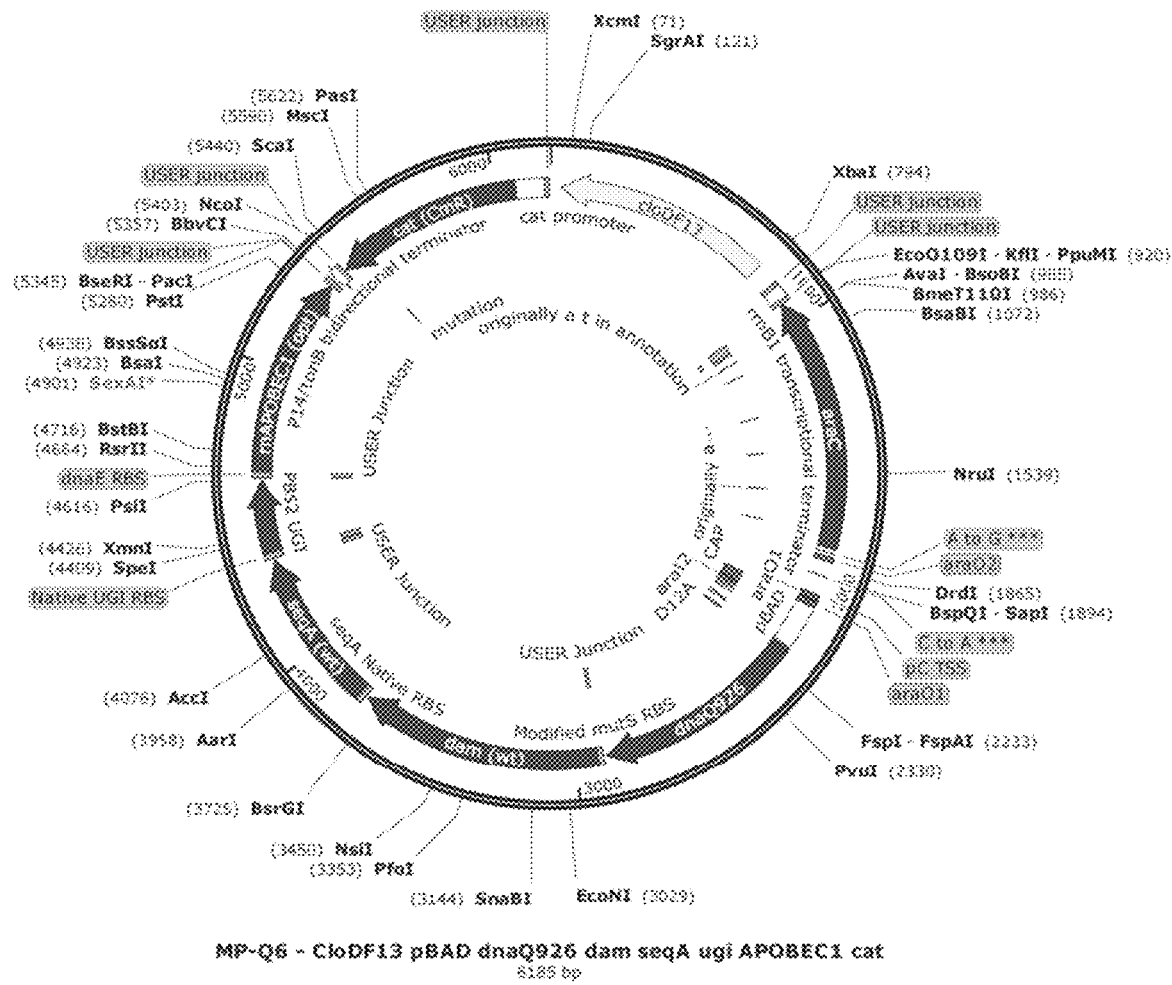
FIG. 80. MP-Q6 Vector Map. A schematic depiction of one embodiment of a MP-Q6 mutagenesis vector is provided, referenced herein as SEQ ID NO: 97. This embodiment comprises araC, dnaQ926, dam, seqA, ugi and mAPOBEC1.
Figure 81:
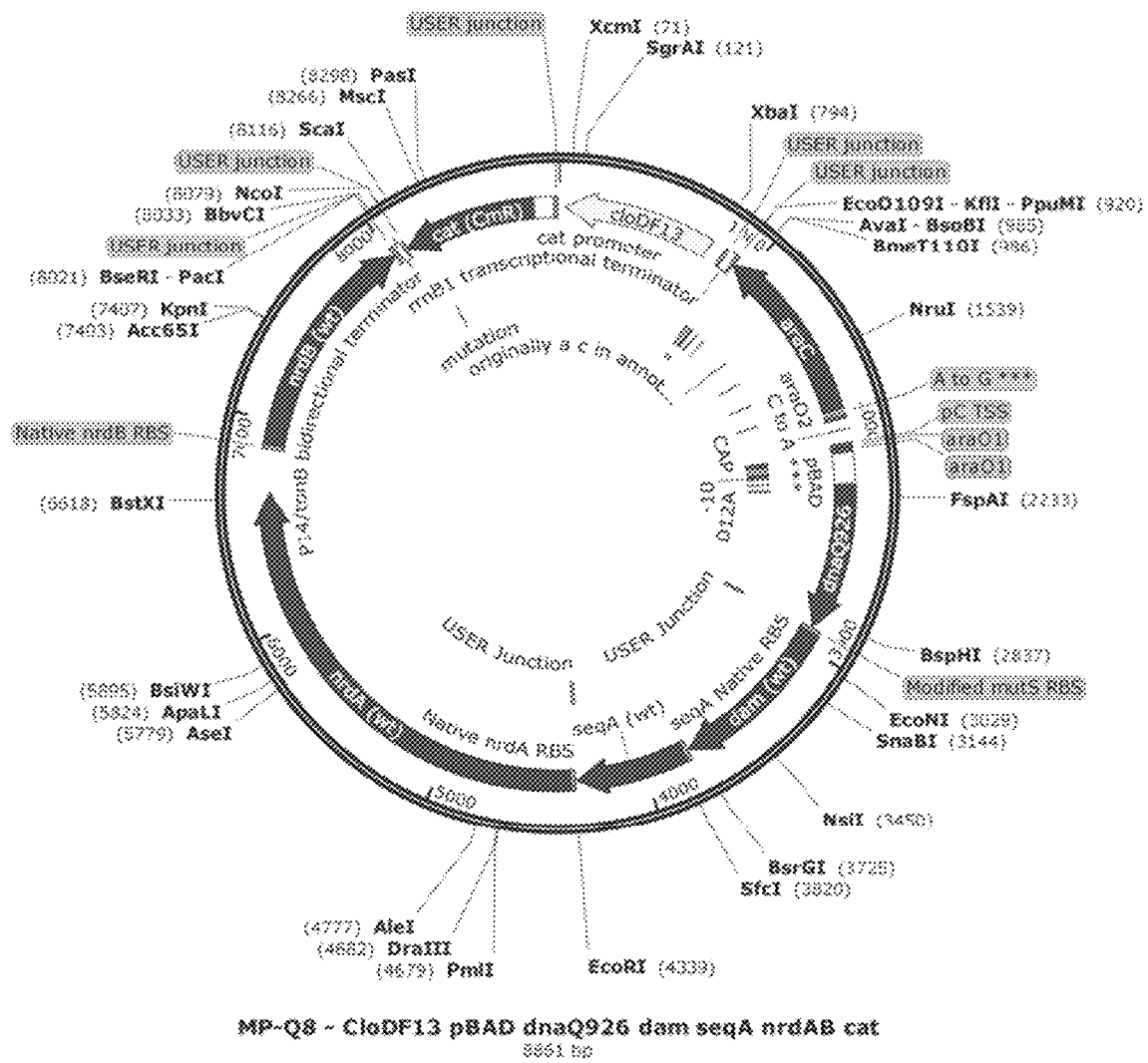
FIG. 81. MP-Q8 Vector Map. A schematic depiction of one embodiment of a MP-Q8 mutagenesis vector is provided, referenced herein as SEQ ID NO: 98. This embodiment comprises araC, dnaQ926, dam, seqA, and nrdAB.
Figure 82:
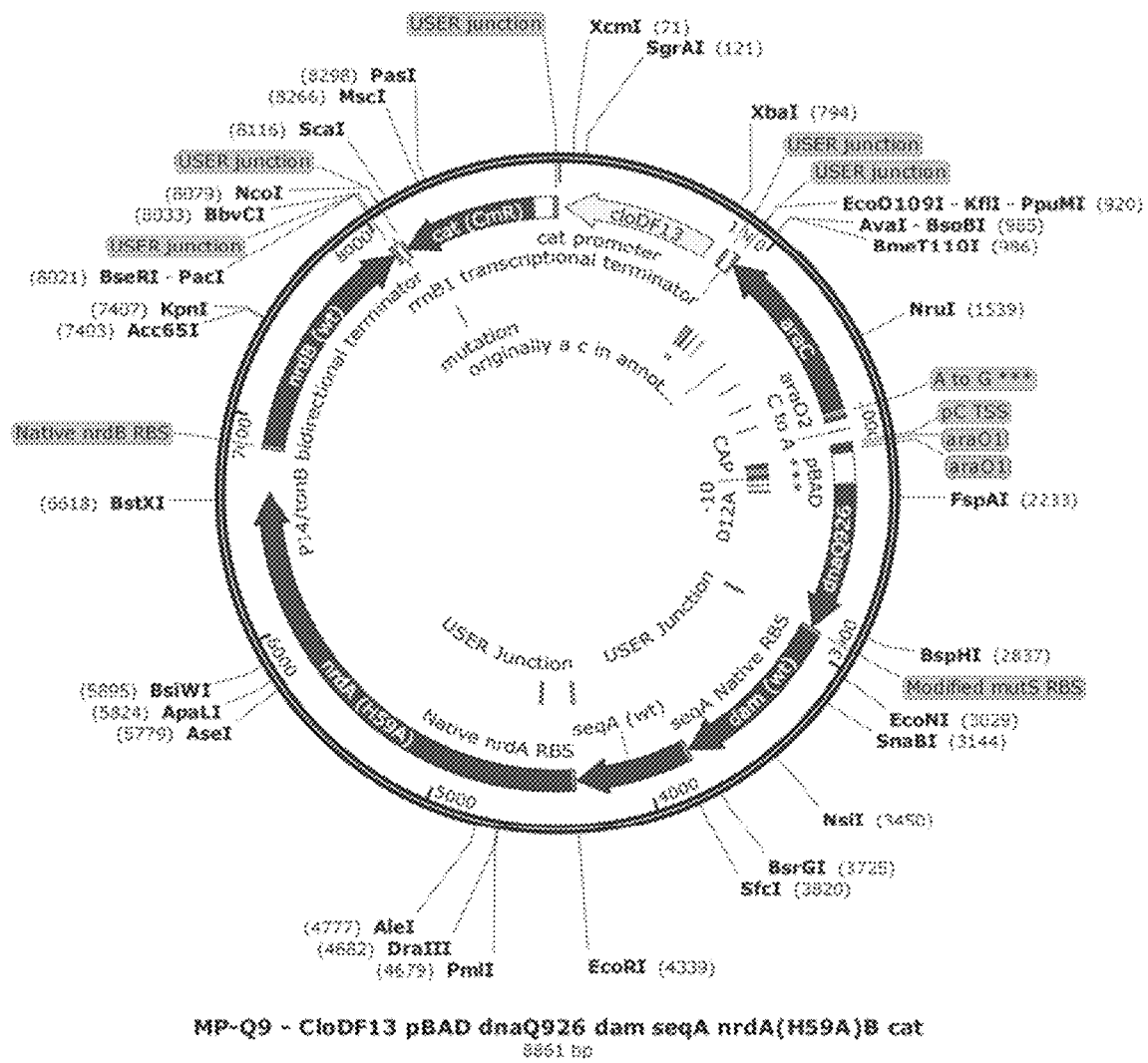
FIG. 82. MP-Q9 Vector Map. A schematic depiction of one embodiment of a MP-Q9 mutagenesis vector is provided, referenced herein as SEQ ID NO: 99. This embodiment comprises araC, dnaQ926, dam, seqA, and nrdA (H59A)B.
Figure 83:
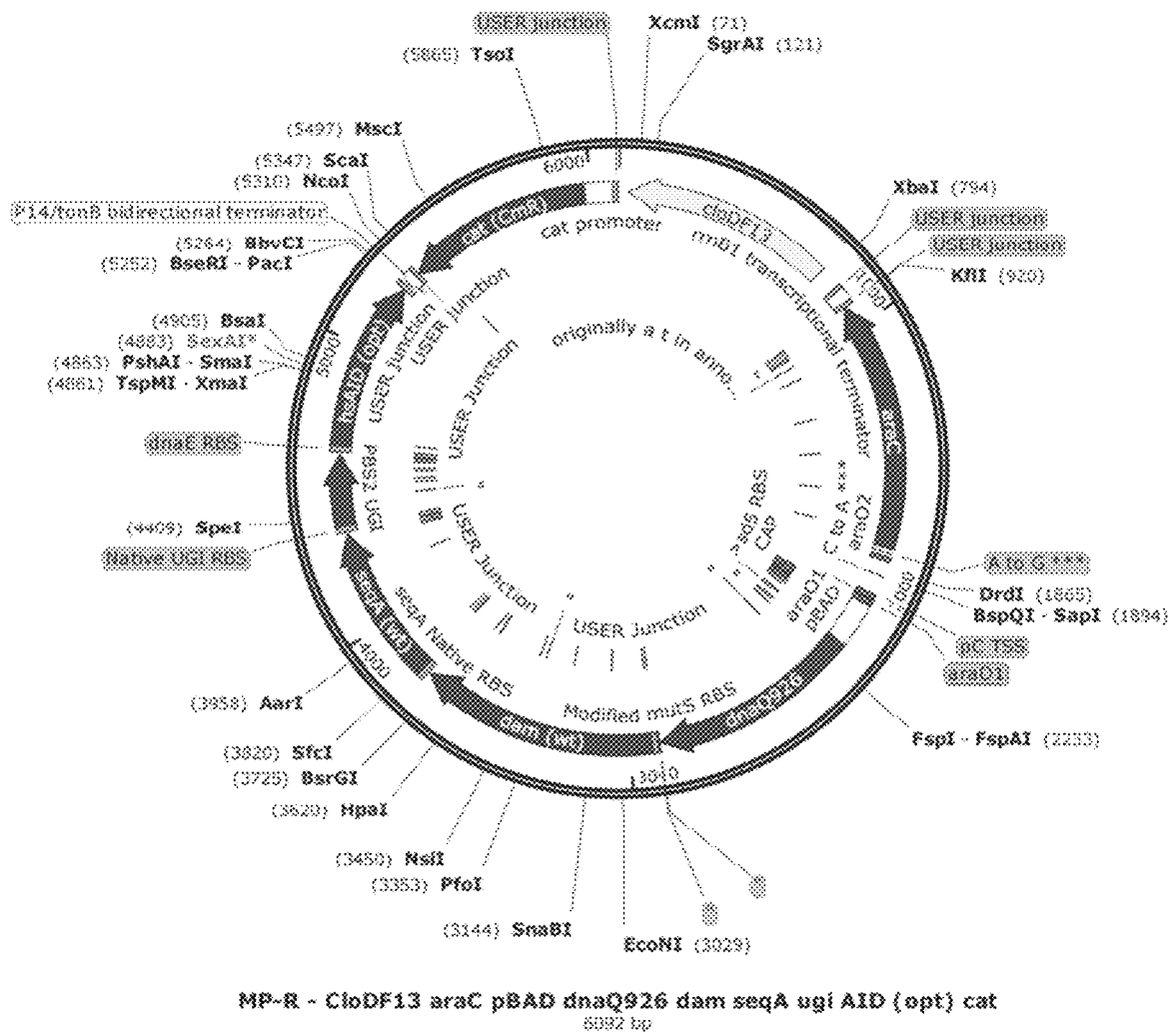
FIG. 83. MP-R Vector Map. A schematic depiction of one embodiment of a MP-R mutagenesis vector is provided, referenced herein as SEQ ID NO: 100. This embodiment comprises araC, dnaQ926, dam, seqA, ugi and hsAID.
Figure 84:
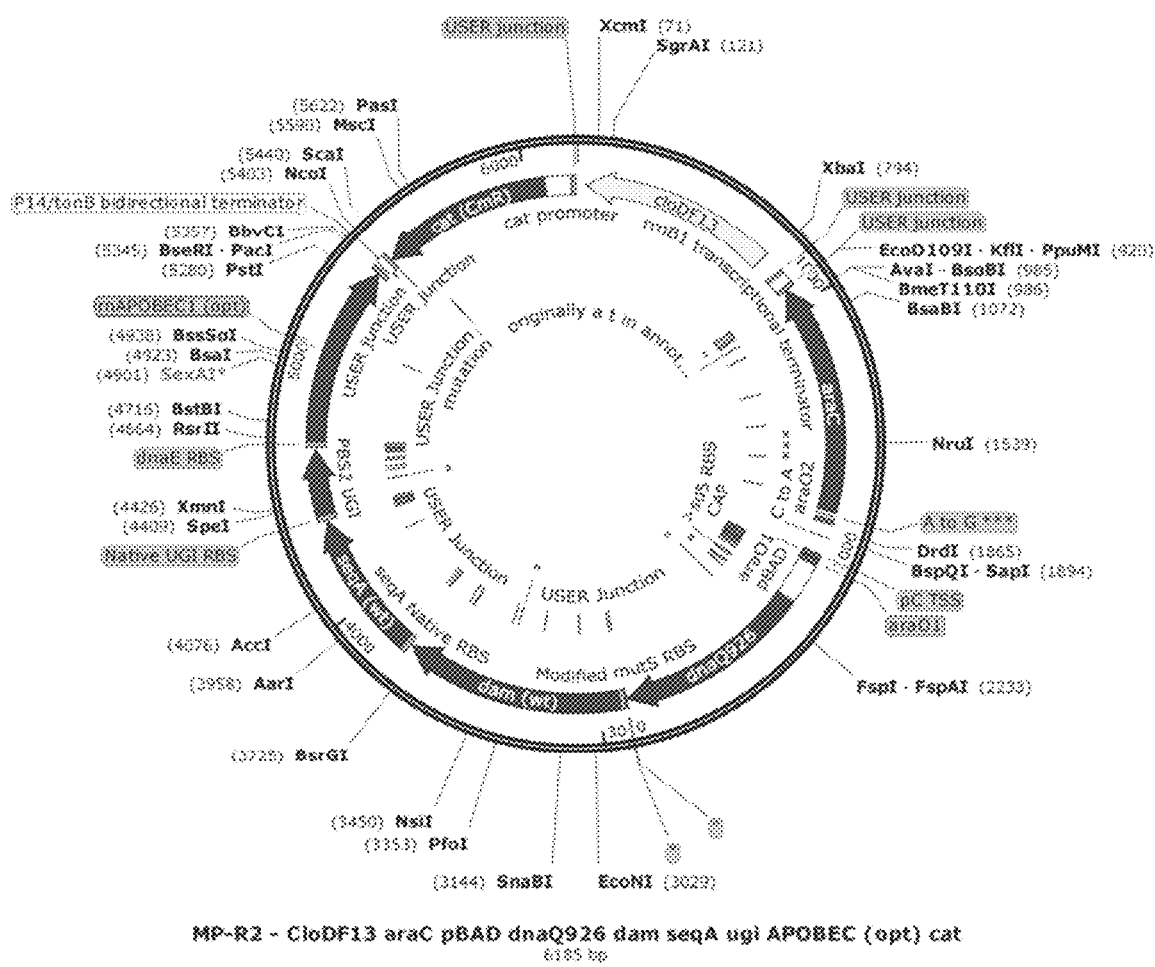
FIG. 84. MP-R2 Vector Map. A schematic depiction of one embodiment of a MP-R2 mutagenesis vector is provided, referenced herein as SEQ ID NO: 101. This embodiment comprises araC, dnaQ926, dam, seqA, ugi and mAPOBEC1.
Figure 85:
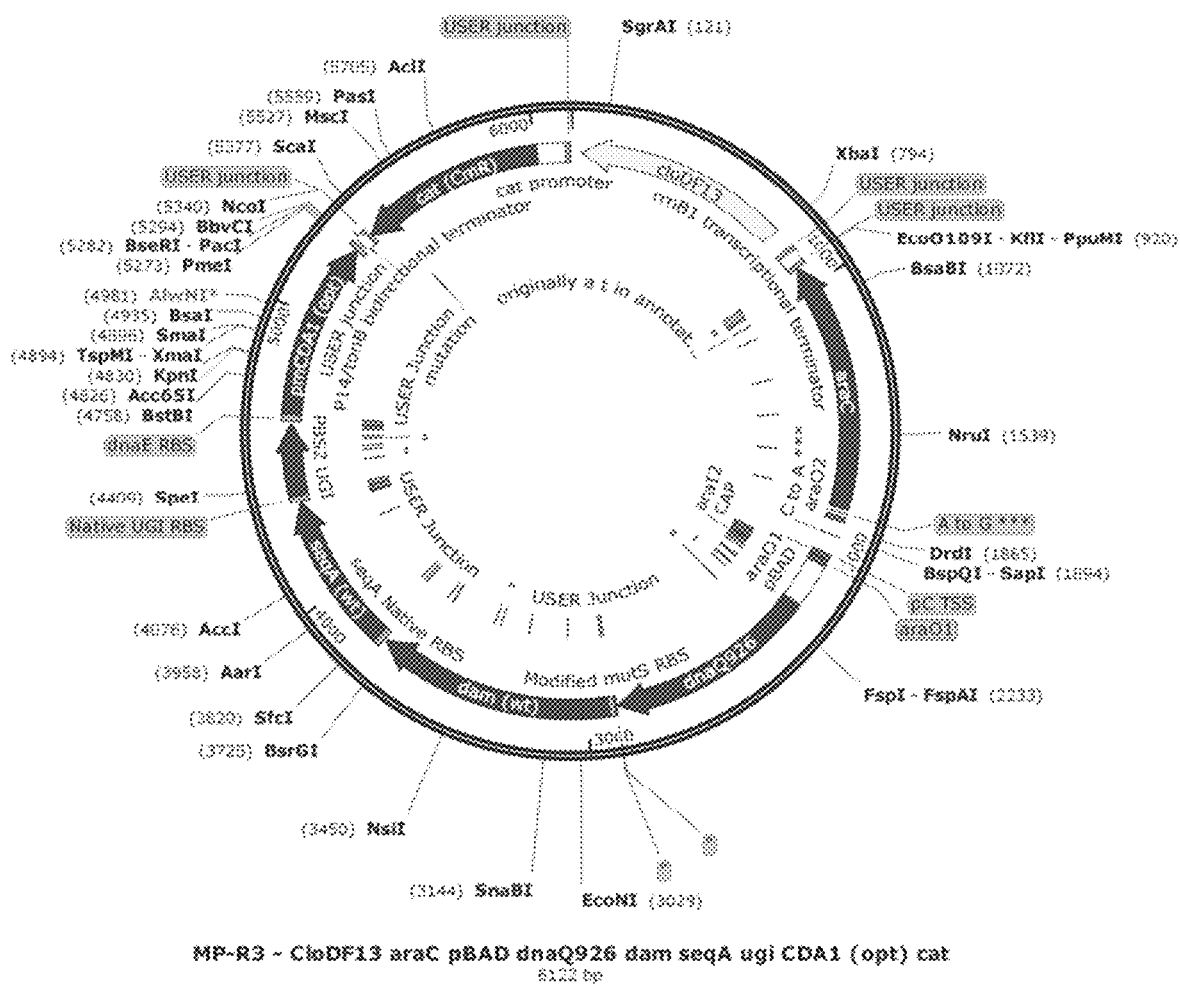
FIG. 85. MP-R3 Vector Map. A schematic depiction of one embodiment of a MP-R3 mutagenesis vector is provided, referenced herein as SEQ ID NO: 102. This embodiment comprises araC, dnaQ926, dam, seqA, ugi and pmCDA1.
Figure 86:
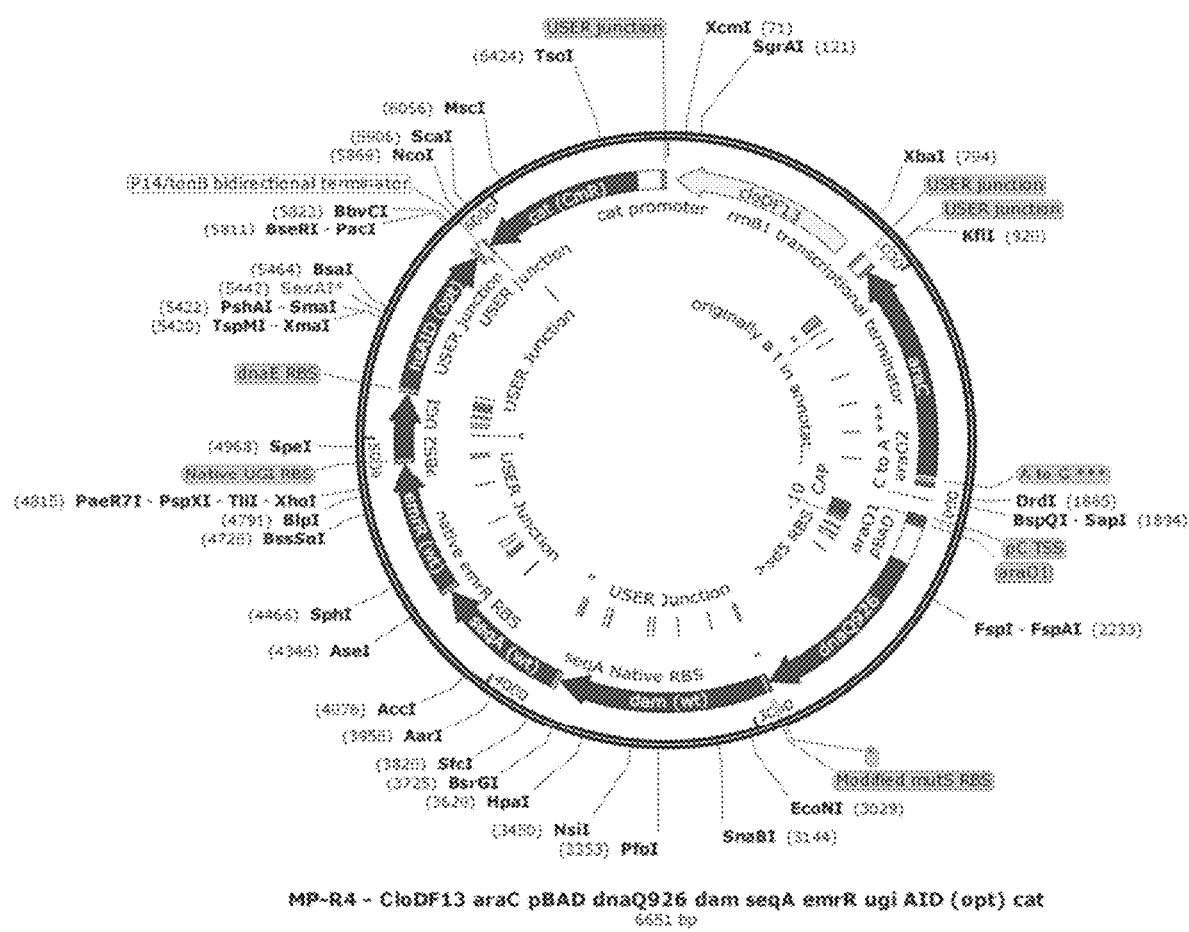
FIG. 86. MP-R4 Vector Map. A schematic depiction of one embodiment of a MP-R4 mutagenesis vector is provided, referenced herein as SEQ ID NO: 103. This embodiment comprises araC, dnaQ926, dam, seqA, emrR, ugi and hsAID.
Figure 87:
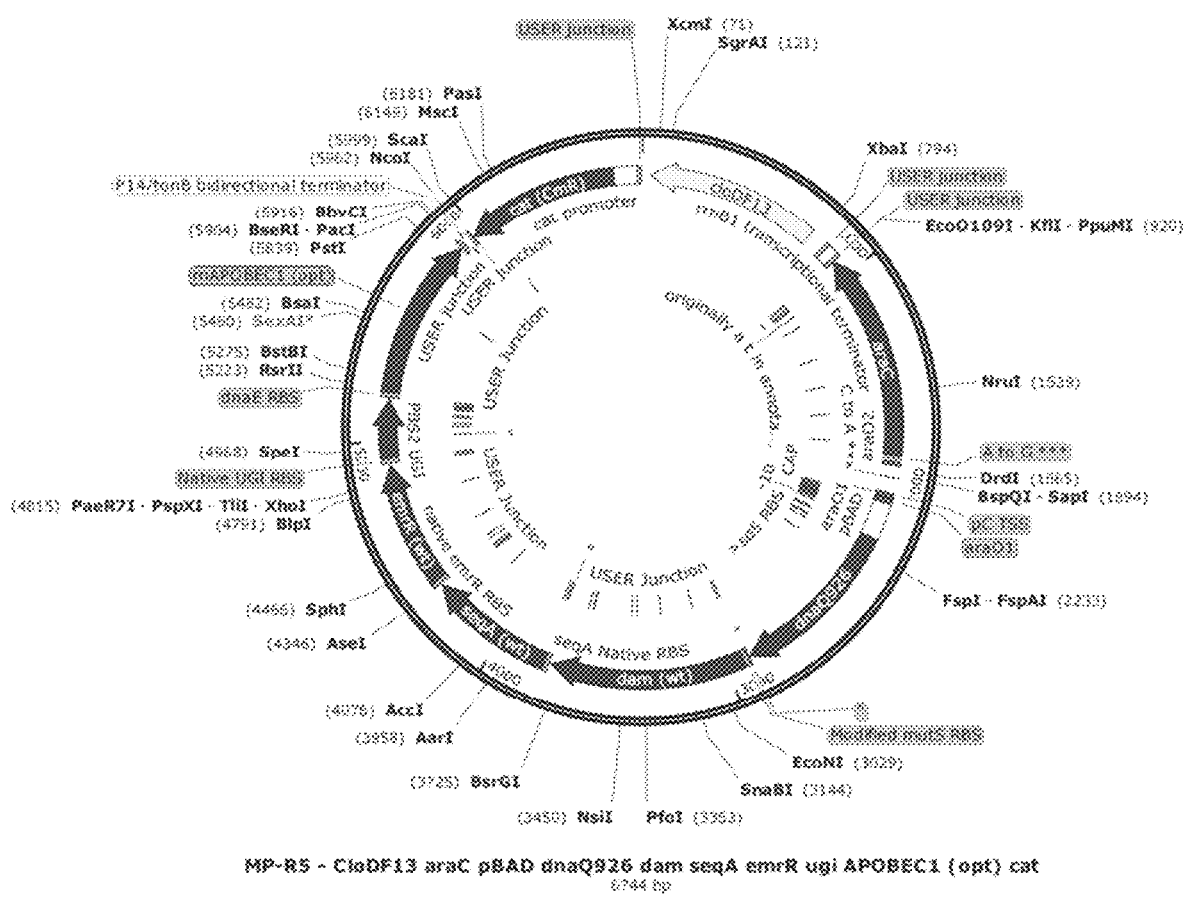
FIG. 87. MP-R5 Vector Map. A schematic depiction of one embodiment of a MP-R5 mutagenesis vector is provided, referenced herein as SEQ ID NO: 104. This embodiment comprises araC, dnaQ926, dam, seqA, emrR, ugi and mAPOBEC1.
Figure 88:
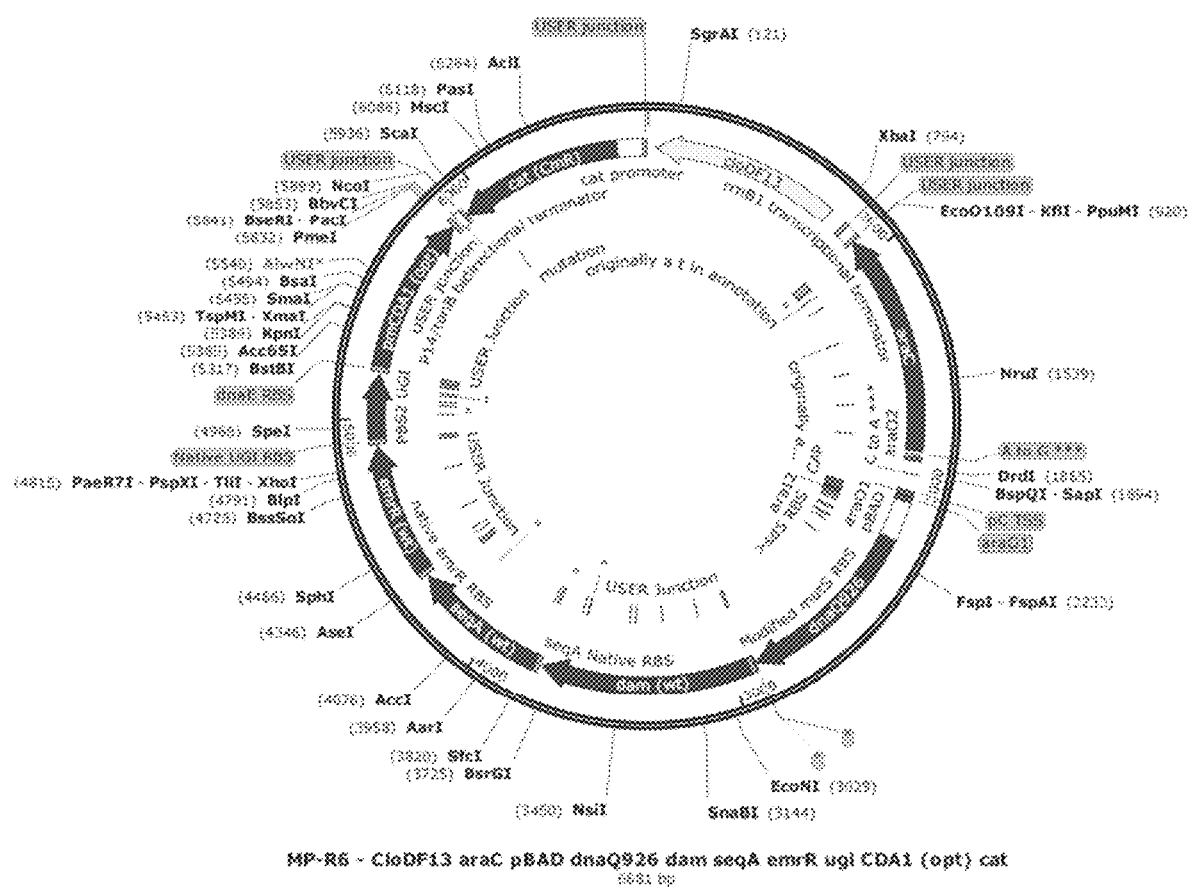
FIG. 88. MP-R6 Vector Map. A schematic depiction of one embodiment of a MP-R6 mutagenesis vector is provided, referenced herein as SEQ ID NO: 105. This embodiment comprises araC, dnaQ926, dam, seqA, emrR, ugi and pmCDA1.
Figure 89:
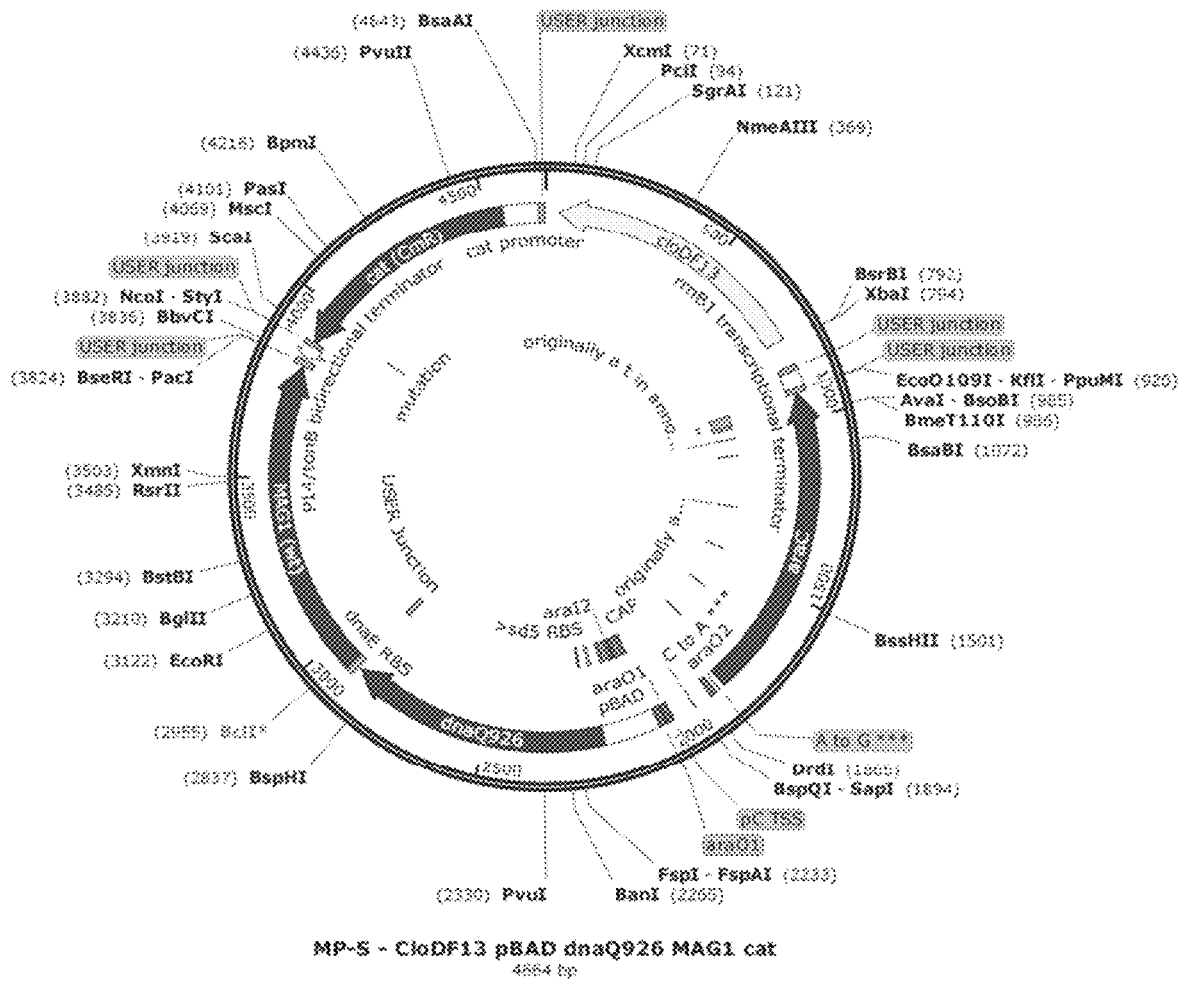
FIG. 89. MP-S Vector Map. A schematic depiction of one embodiment of a MP-S mutagenesis vector is provided, referenced herein as SEQ ID NO: 106. This embodiment comprises araC, dnaQ926, and MAG1.
Figure 90:
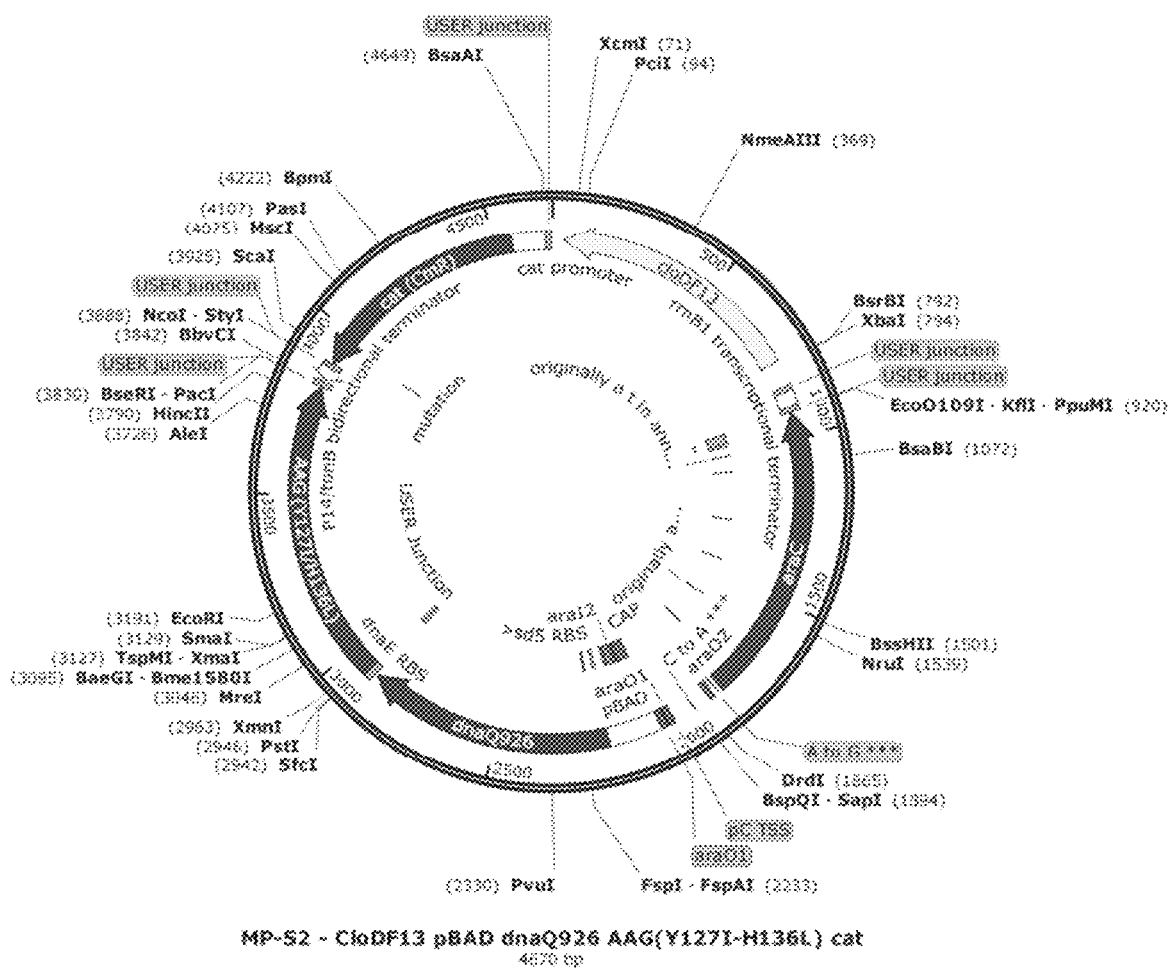
FIG. 90. MP-S2 Vector Map. A schematic depiction of one embodiment of a MP-S2 mutagenesis vector is provided, referenced herein as SEQ ID NO: 107. This embodiment comprises araC, dnaQ926, and AAG(Y127I-H136L).
Figure 91:
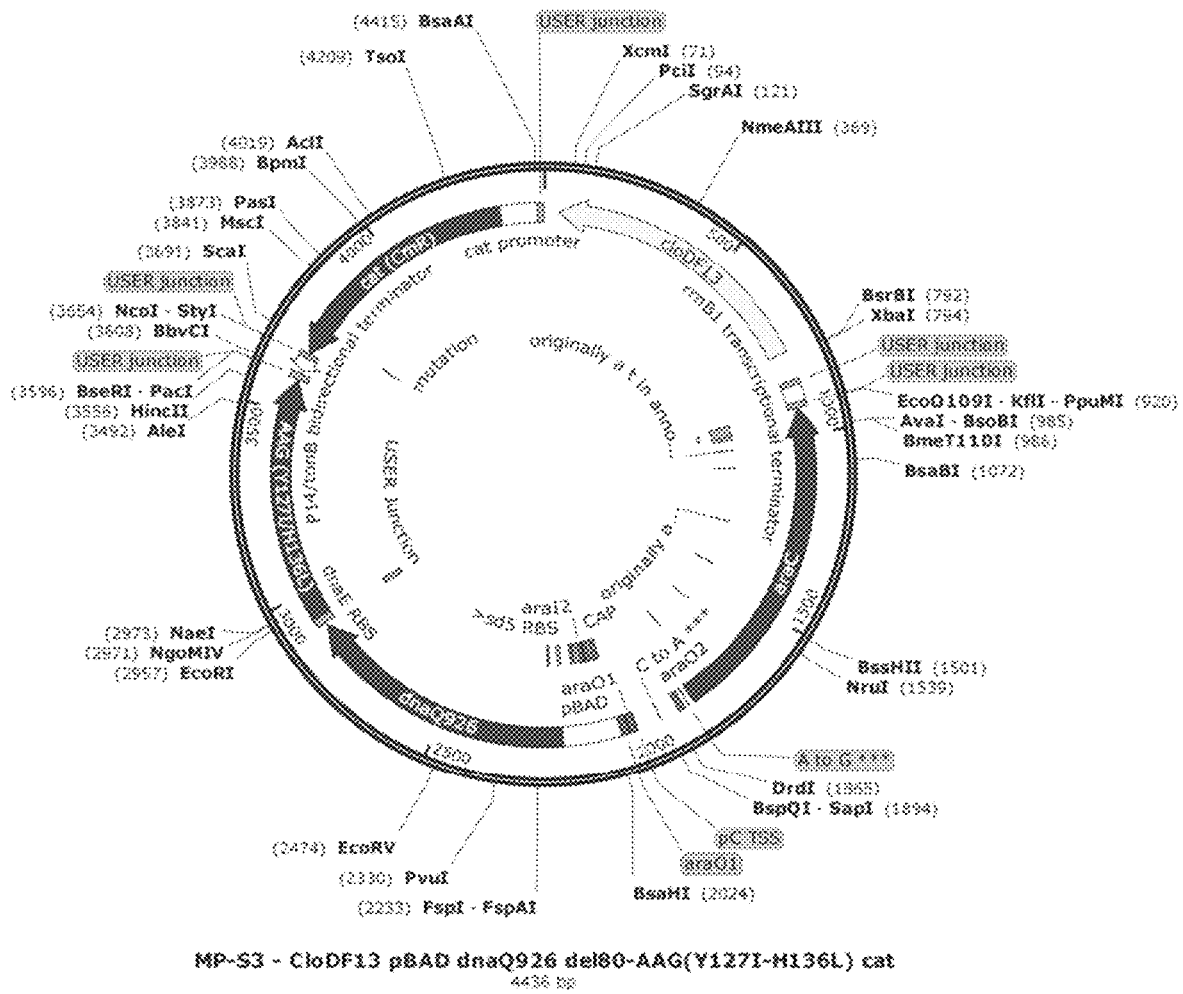
FIG. 91. MP-S3 Vector Map. A schematic depiction of one embodiment of a MP-S3 mutagenesis vector is provided, referenced herein as SEQ ID NO: 108. This embodiment comprises araC, dnaQ926, and de180-AAG(Y127I-H136L).
Figure 92:
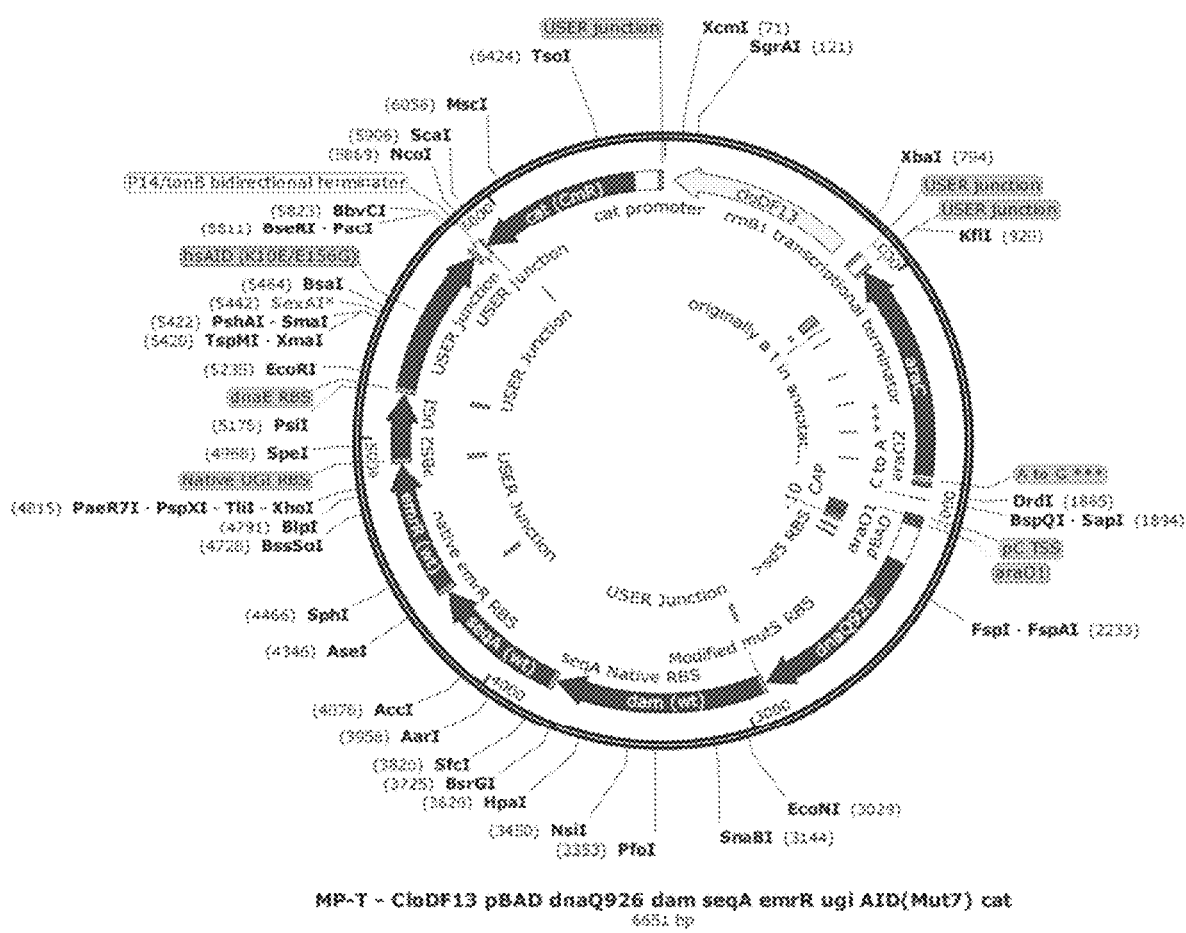
FIG. 92. MP-T Vector Map. A schematic depiction of one embodiment of a MP-T mutagenesis vector is provided, referenced herein as SEQ ID NO: 109. This embodiment comprises araC, dnaQ926, dam, seqA, emrR, ugi and hsAID (K10E/E156G).
Figure 93:
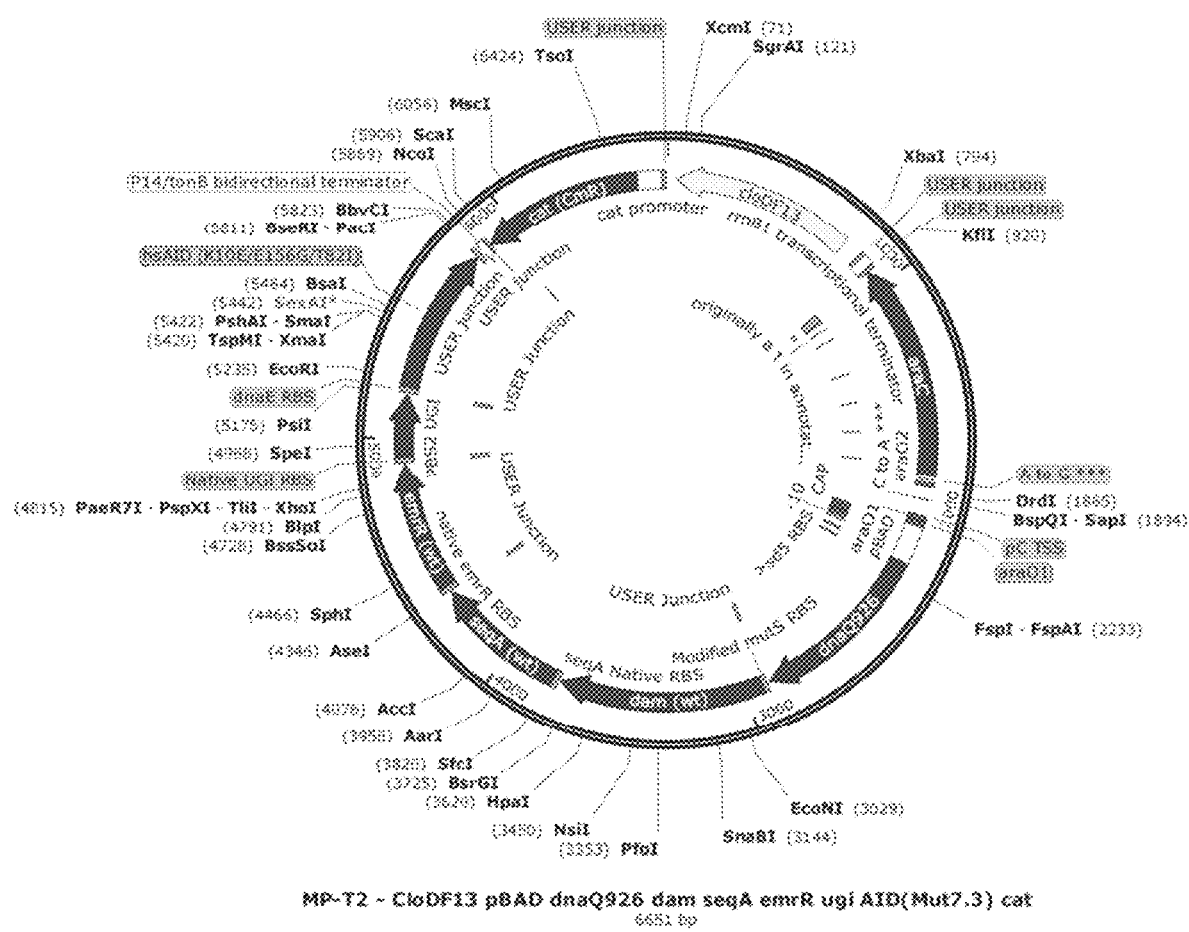
FIG. 93. MP-T2 Vector Map. A schematic depiction of one embodiment of a MP-T2 mutagenesis vector is provided, referenced herein as SEQ ID NO: 110. This embodiment comprises araC, dnaQ926, dam, seqA, emrR, ugi and hsAID (K10E/E156G/T82I).
Figure 94:
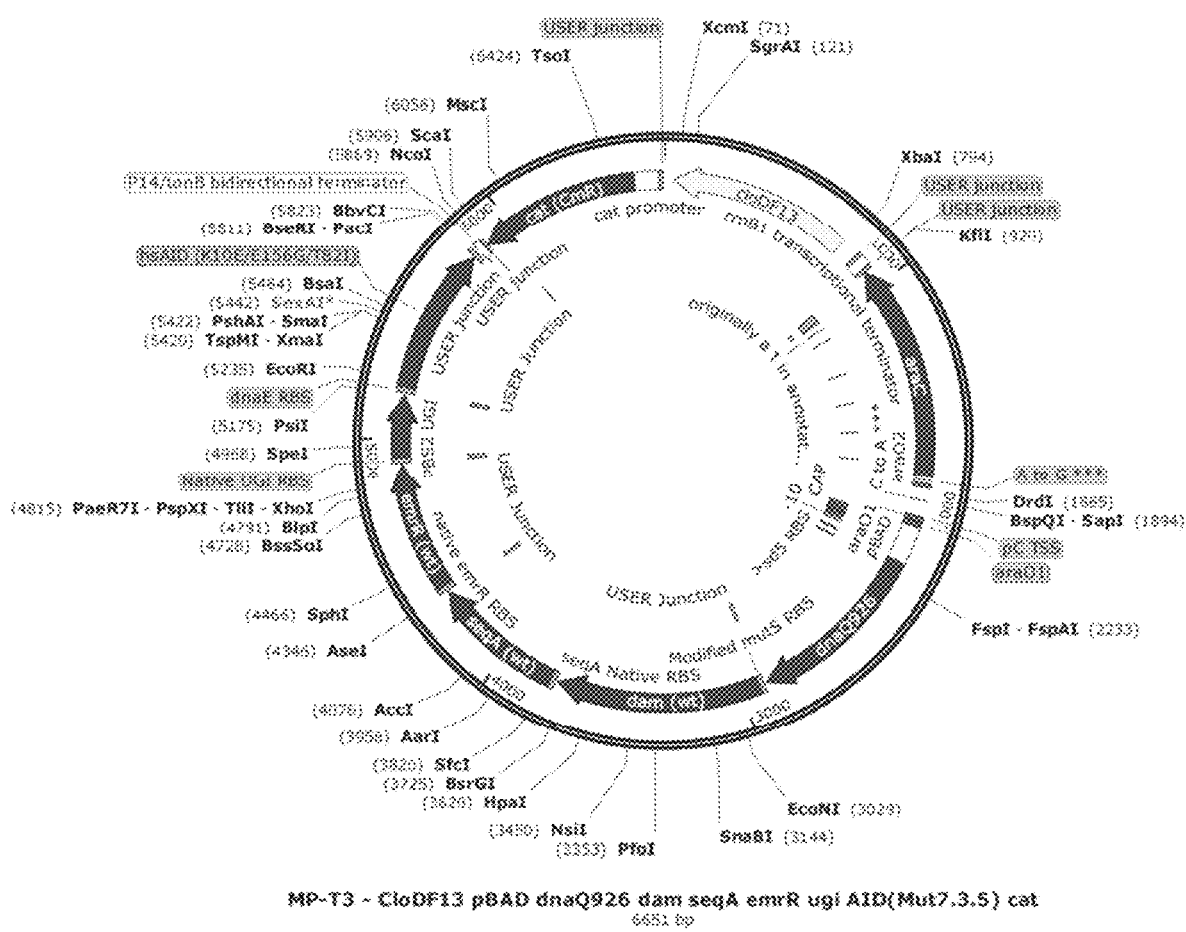
FIG. 94. MP-T3 Vector Map. A schematic depiction of one embodiment of a MP-T3 mutagenesis vector is provided, referenced herein as SEQ ID NO: 111. This embodiment comprises araC, dnaQ926, dam, seqA, emrR, ugi and hsAID (K10E/E156G/T82I).
Figure 95:
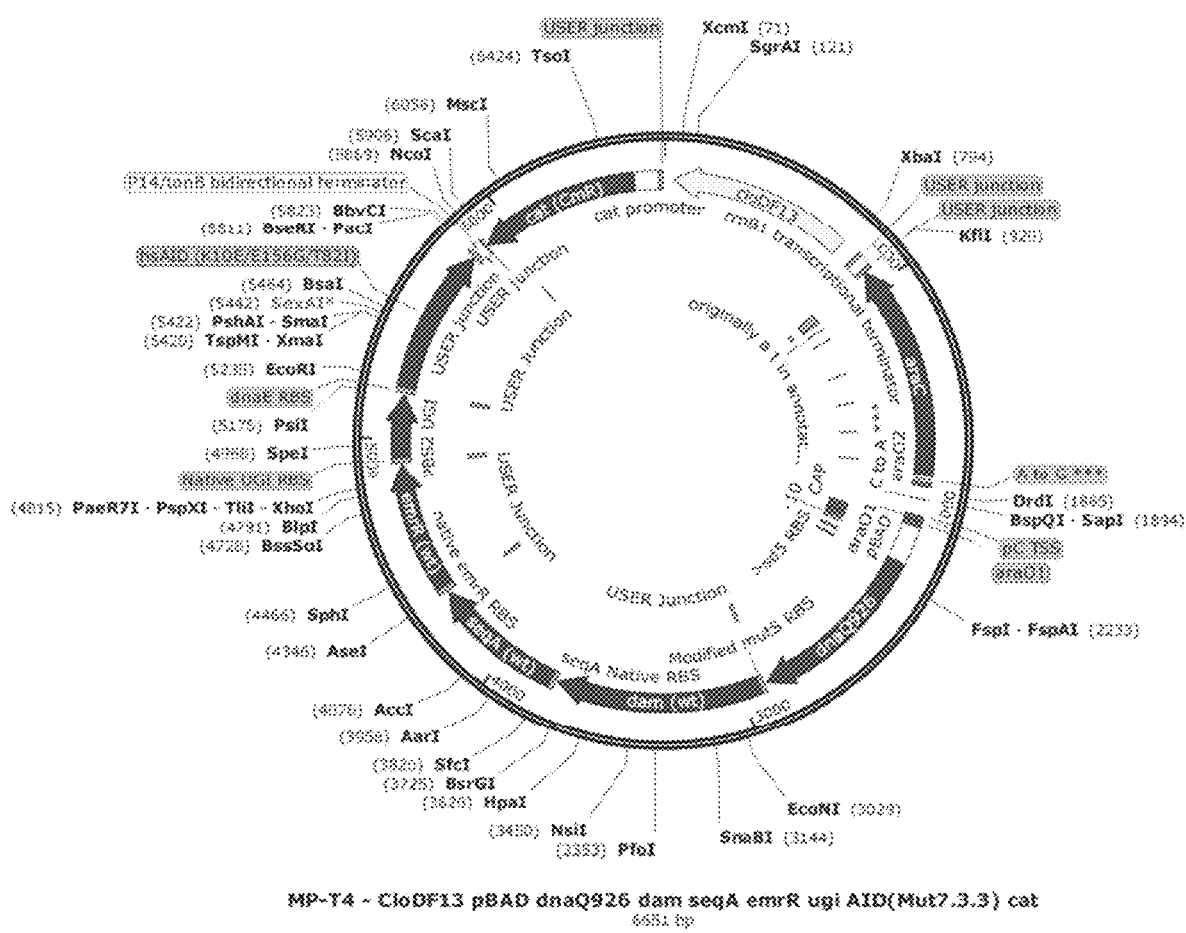
FIG. 95. MP-T4 Vector Map. A schematic depiction of one embodiment of a MP-T4 mutagenesis vector is provided, referenced herein as SEQ ID NO: 112. This embodiment comprises araC, dnaQ926, dam, seqA, emrR, ugi and hsAID (K10E/E156G/T82I).
Figure 96:
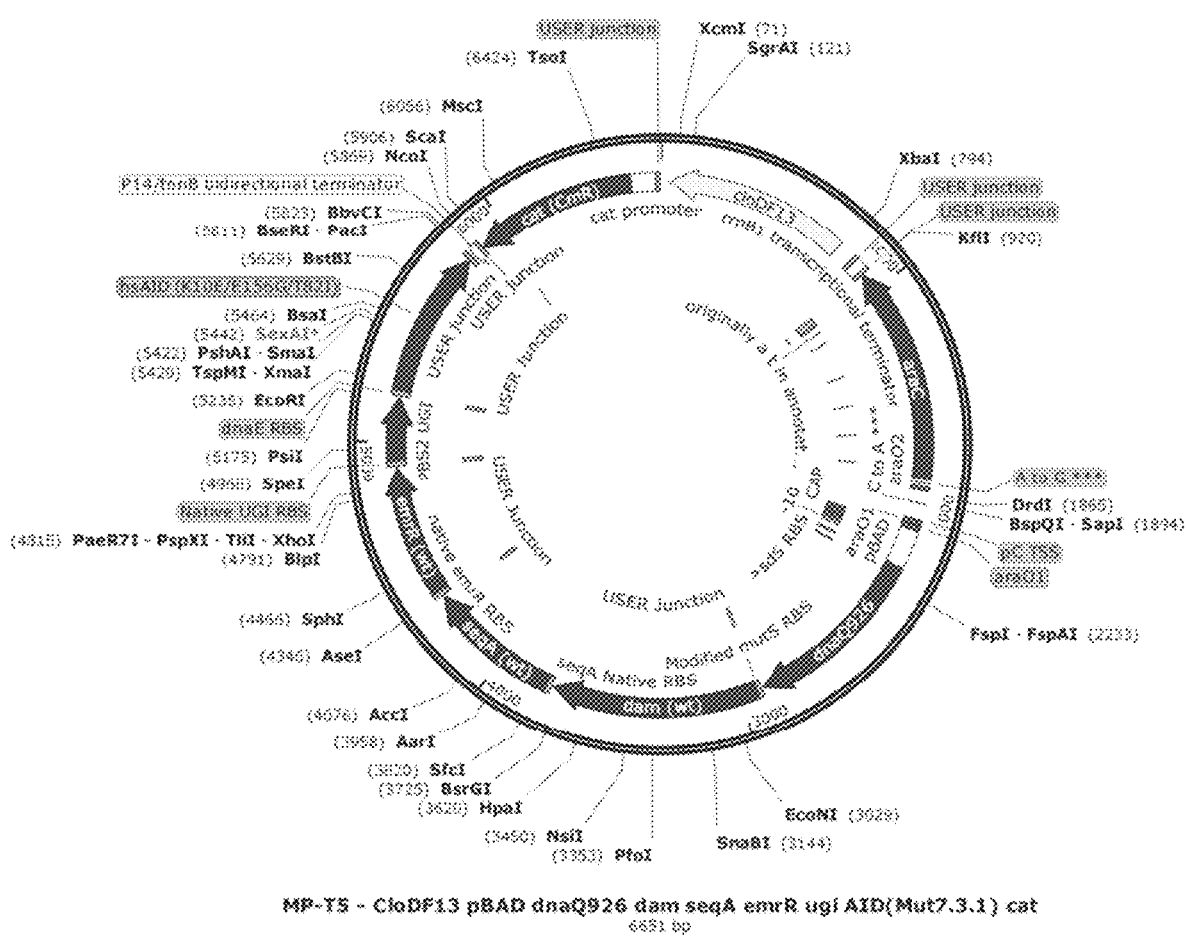
FIG. 96. MP-T5 Vector Map. A schematic depiction of one embodiment of a MP-T5 mutagenesis vector is provided, referenced herein as SEQ ID NO: 113. This embodiment comprises araC, dnaQ926, dam, seqA, emrR, ugi and hsAID (K10E/E156G/T82I).
Figure 97:
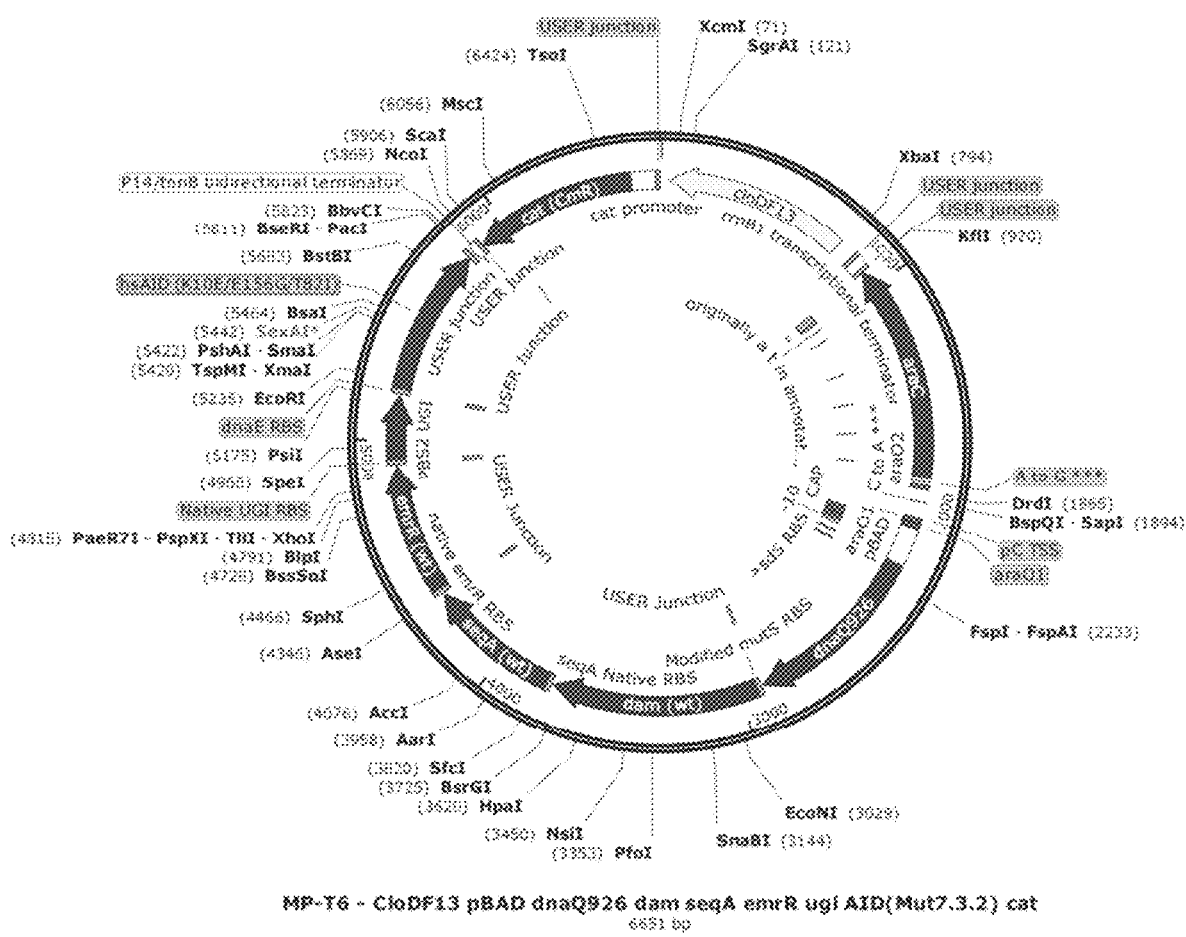
FIG. 97. MP-T6 Vector Map. A schematic depiction of one embodiment of a MP-T6 mutagenesis vector is provided, referenced herein as SEQ ID NO: 114. This embodiment comprises araC, dnaQ926, dam, seqA, emrR, ugi and hsAID (K10E/E156G/T82I).
Figure 98:
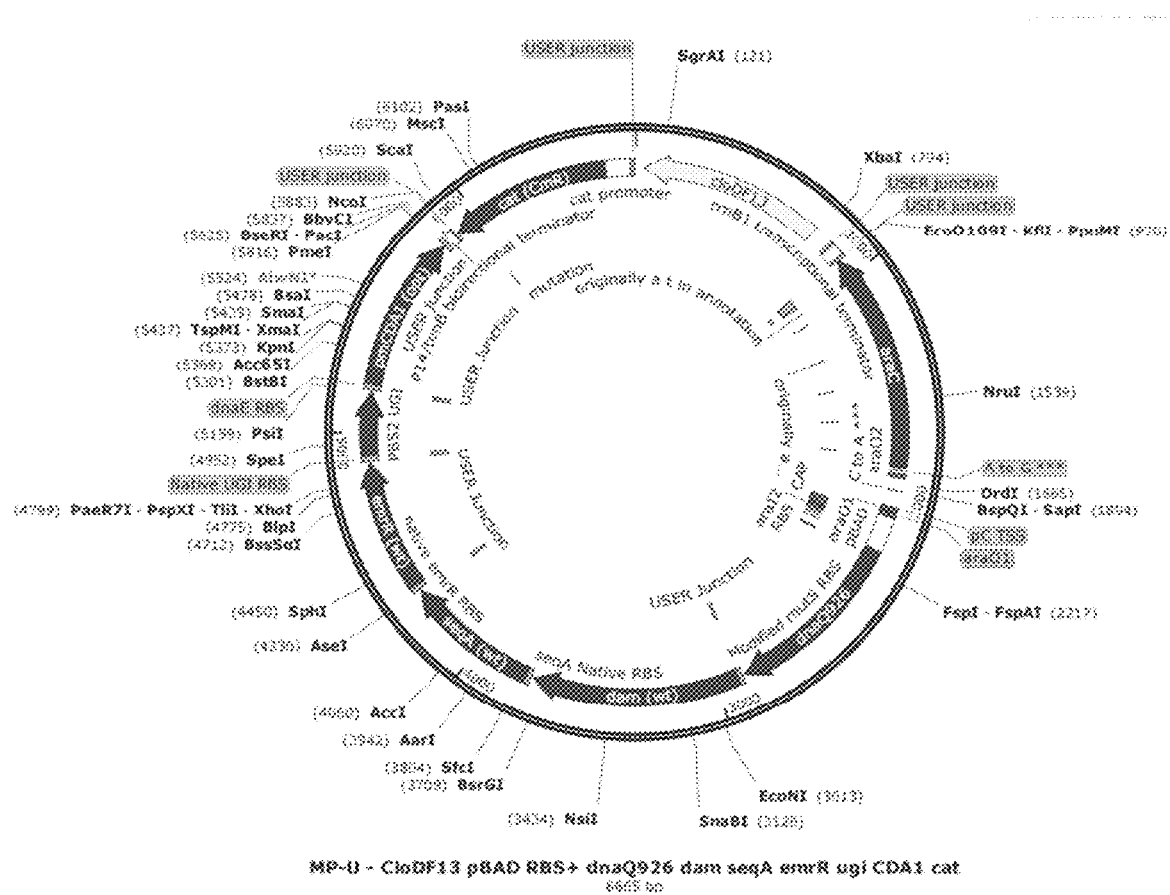
FIG. 98. MP-U Vector Map. A schematic depiction of one embodiment of a MP-U mutagenesis vector is provided, referenced herein as SEQ ID NO: 115. This embodiment comprises araC, dnaQ926, dam, seqA, emrR, ugi and pmCDA1.
Figure 99:
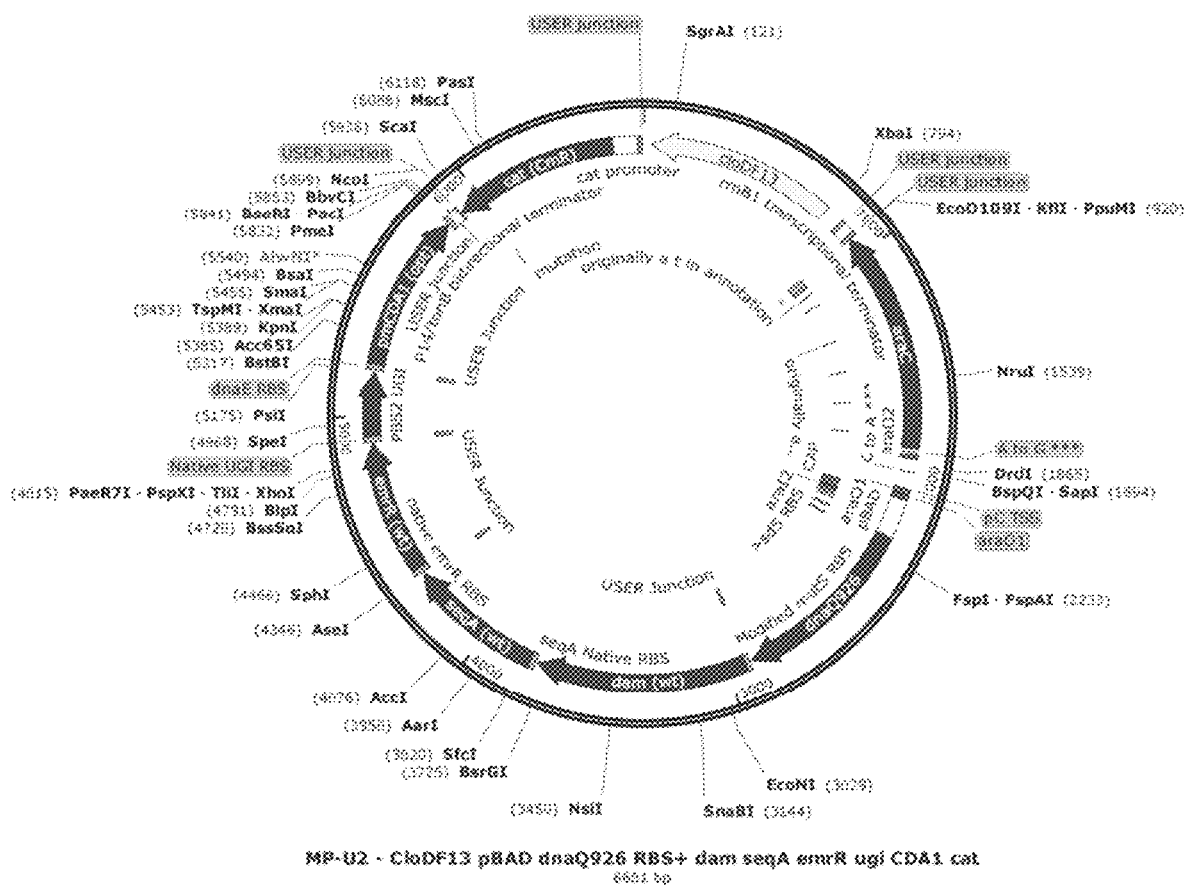
FIG. 99. MP-U2 Vector Map. A schematic depiction of one embodiment of a MP-U2 mutagenesis vector is provided, referenced herein as SEQ ID NO: 116. This embodiment comprises araC, dnaQ926 RBS+, dam, seqA, emrR, ugi and pmCDA1.
Figure 100:
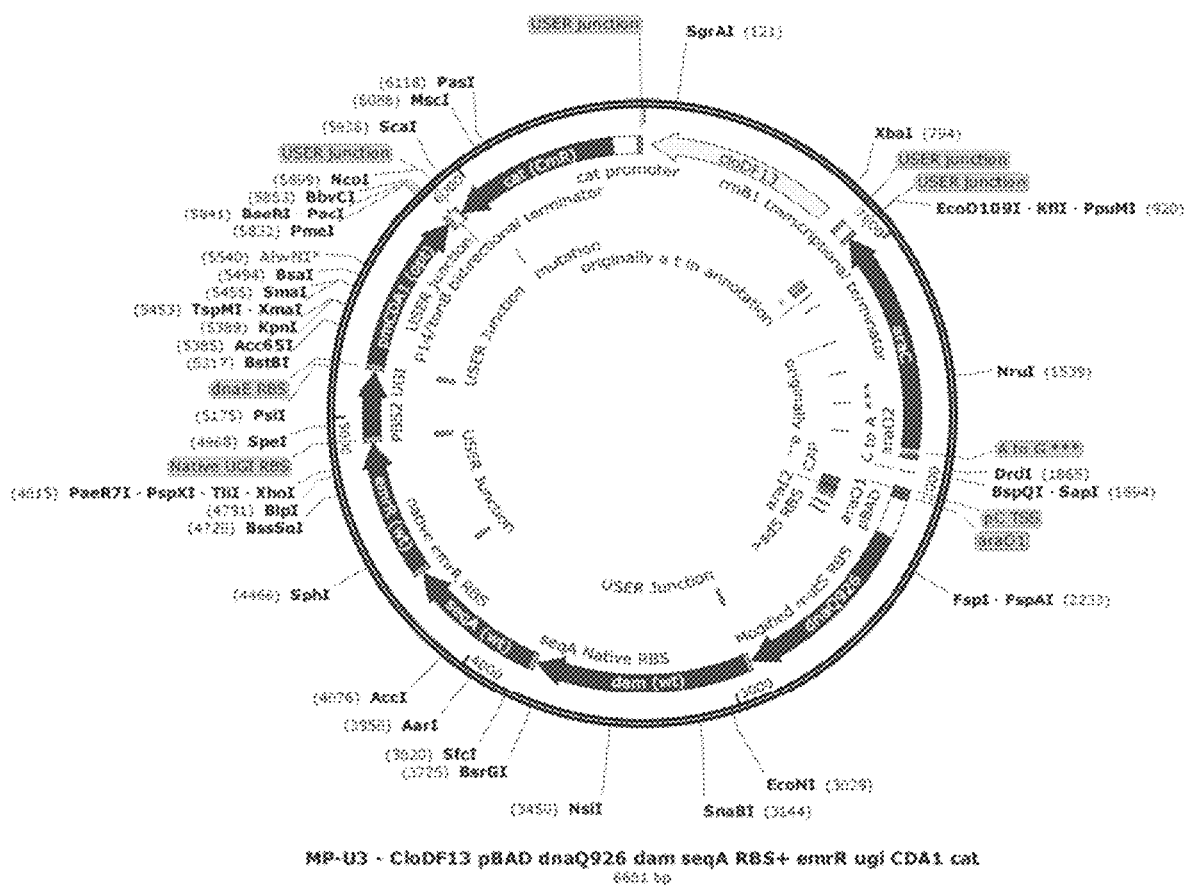
FIG. 100. MP-U3 Vector Map. A schematic depiction of one embodiment of a MP-U3 mutagenesis vector is provided, referenced herein as SEQ ID NO: 117. This embodiment comprises araC, dnaQ926, dam, seqA RBS+, emrR, ugi and pmCDA1.
Figure 101:
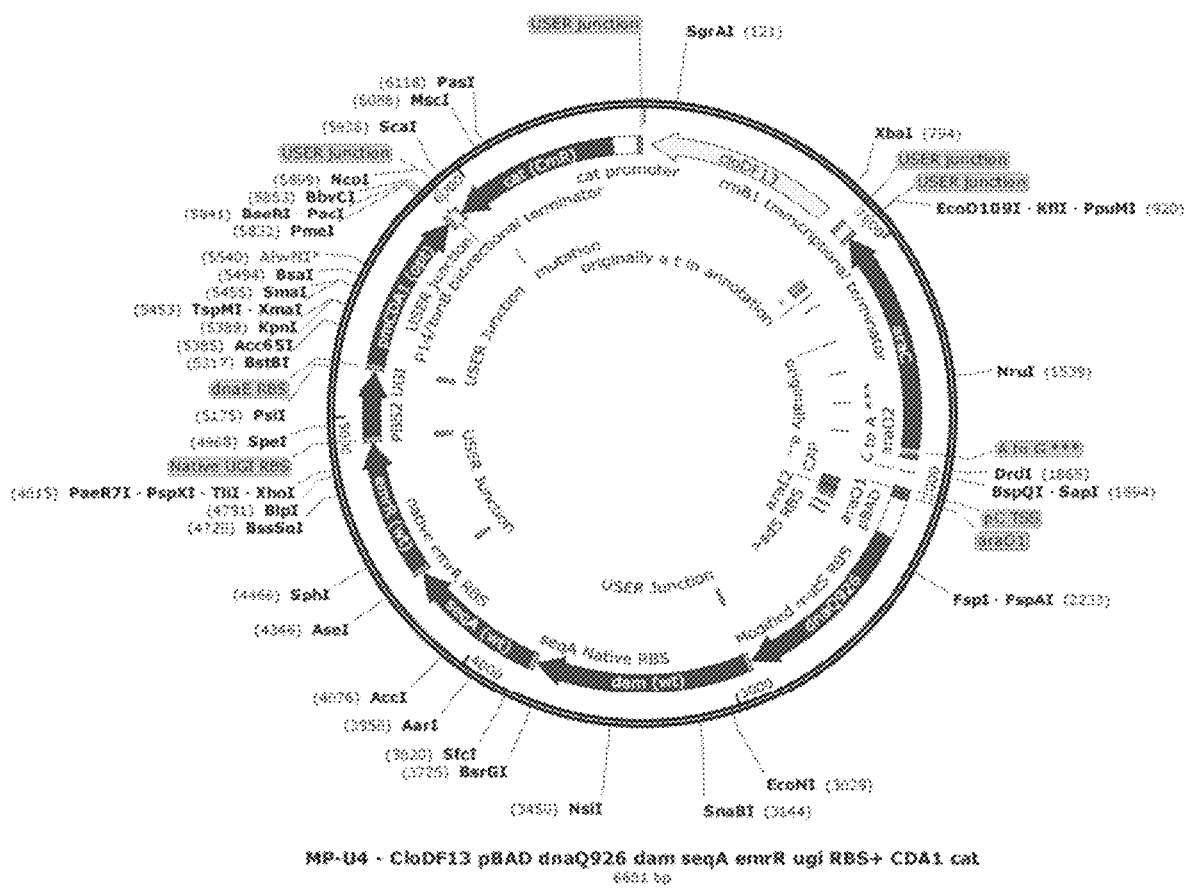
FIG. 101. MP-U4 Vector Map. A schematic depiction of one embodiment of a MP-U4 mutagenesis vector is provided, referenced herein as SEQ ID NO: 118. This embodiment comprises araC, dnaQ926, dam, seqA, emrR, ugi RBS+ and pmCDA1.
Figure 102:
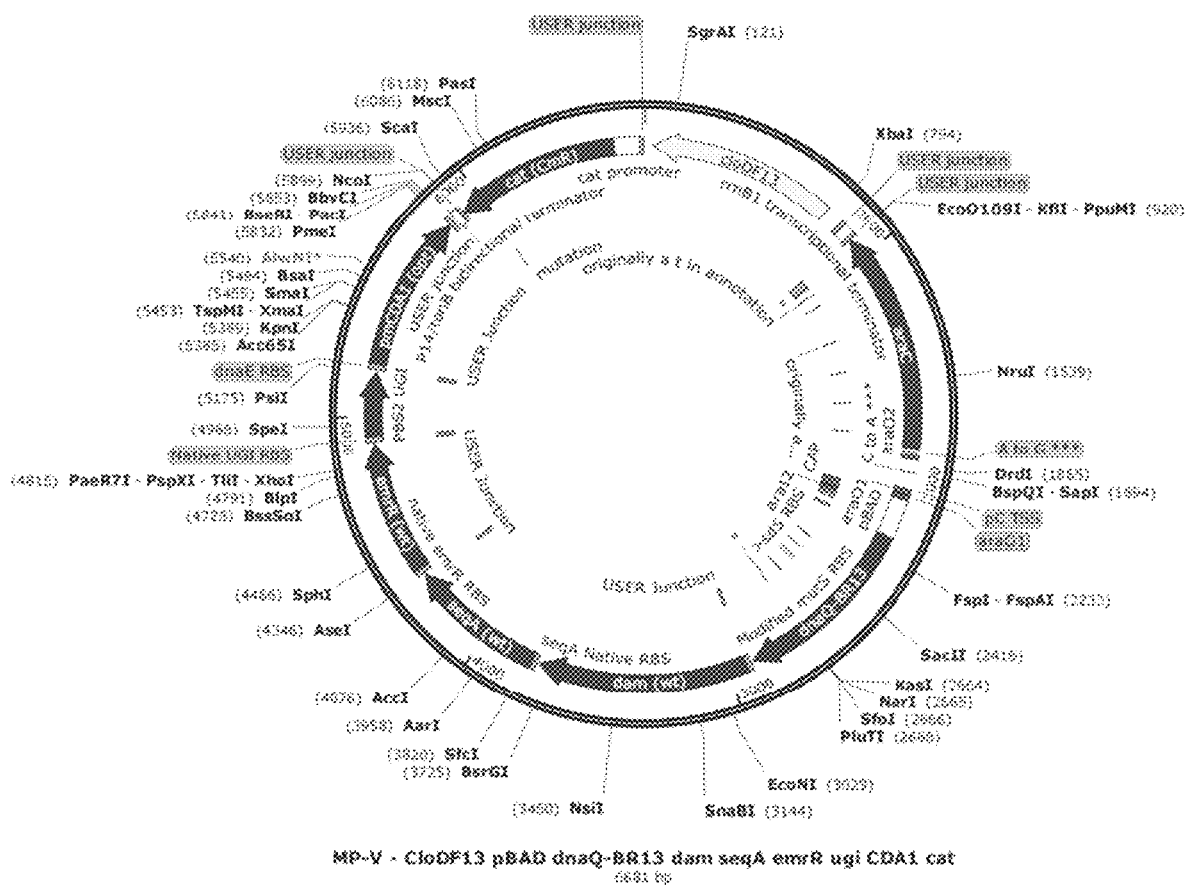
FIG. 102. MP-V Vector Map. A schematic depiction of one embodiment of a MP-V mutagenesis vector is provided, referenced herein as SEQ ID NO: 119. This embodiment comprises araC, dnaQ-BR13, dam, seqA, emrR, ugi and pmCDA1.
Figure 103:
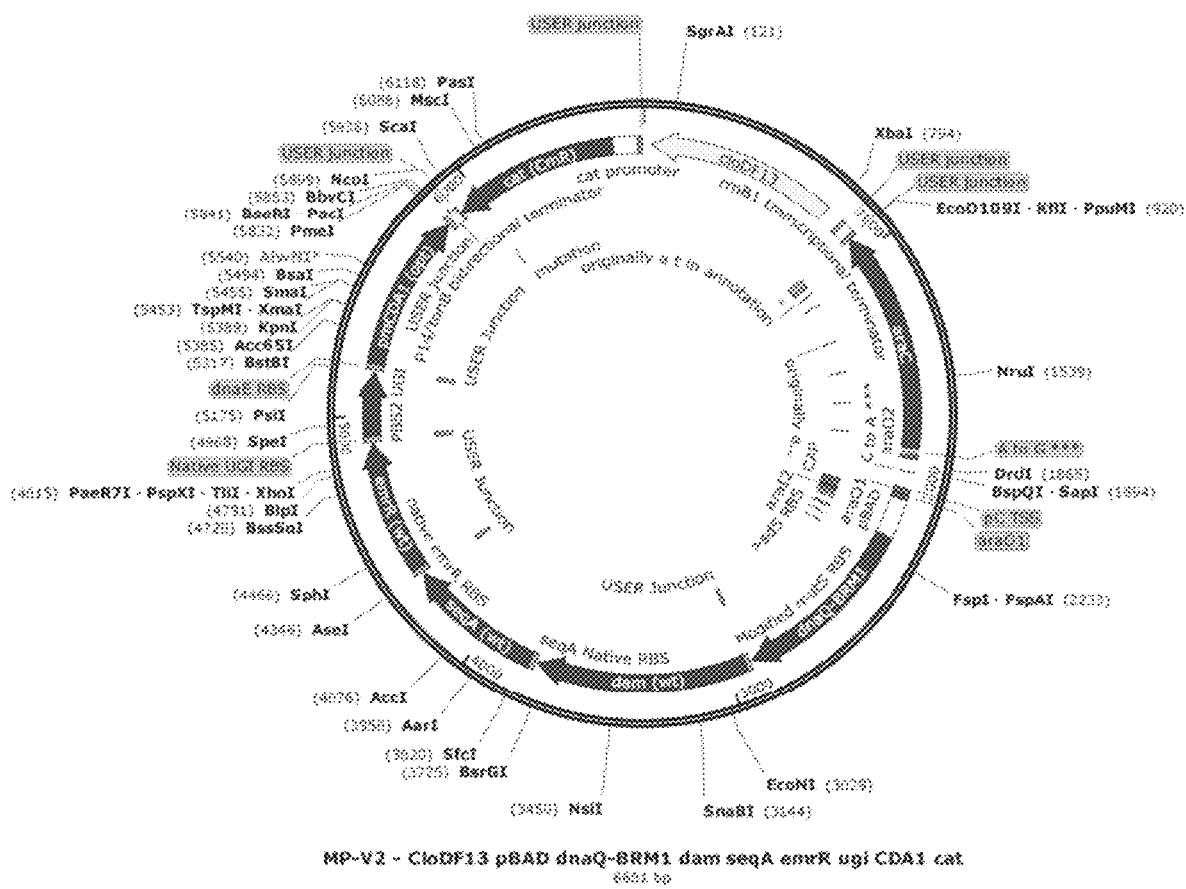
FIG. 103. MP-V2 Vector Map. A schematic depiction of one embodiment of a MP-V2 mutagenesis vector is provided, referenced herein as SEQ ID NO: 120. This embodiment comprises araC, dnaQ-BRM1, dam, seqA, emrR, ugi and pmCDA1.
Figure 104:
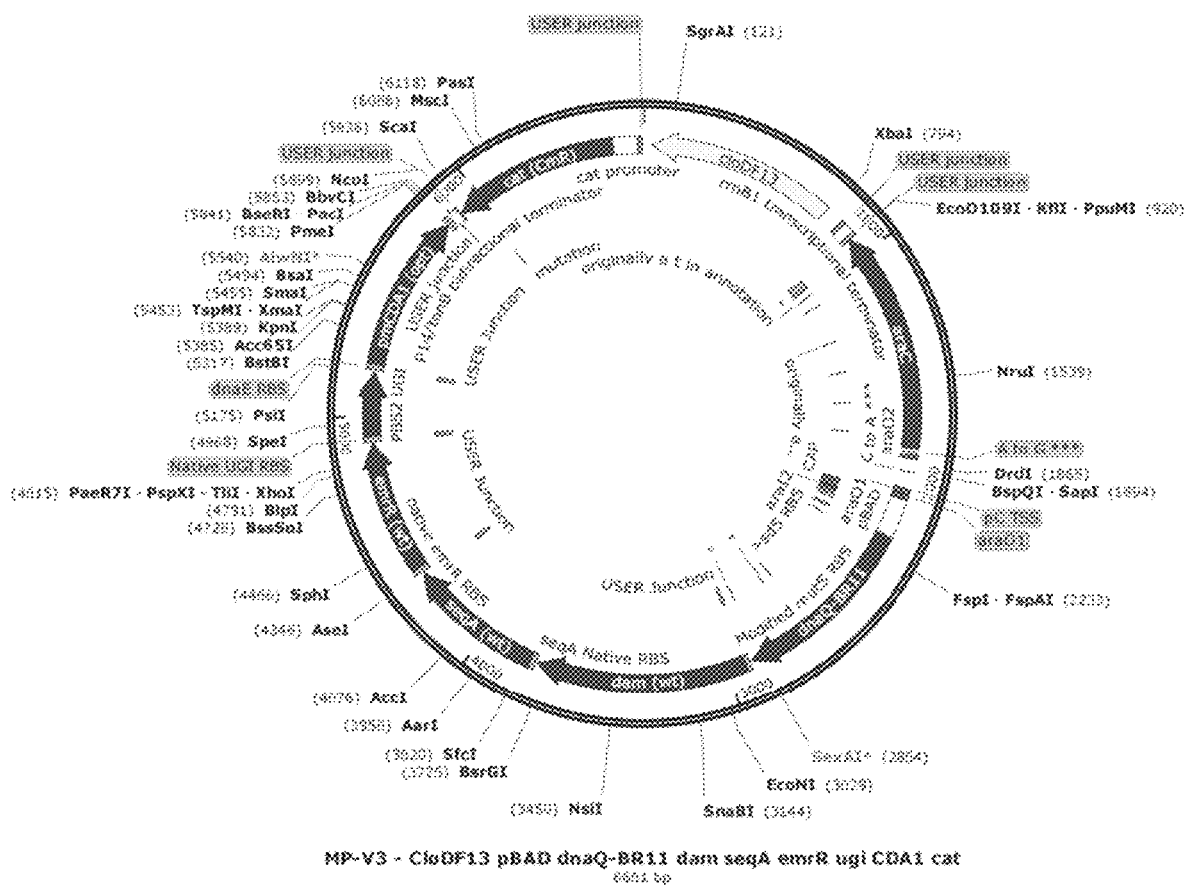
FIG. 104. MP-V3 Vector Map. A schematic depiction of one embodiment of a MP-V3 mutagenesis vector is provided, referenced herein as SEQ ID NO: 121. This embodiment comprises araC, dnaQ-BR11, dam, seqA, emrR, ugi and pmCDA1.
Figure 105:
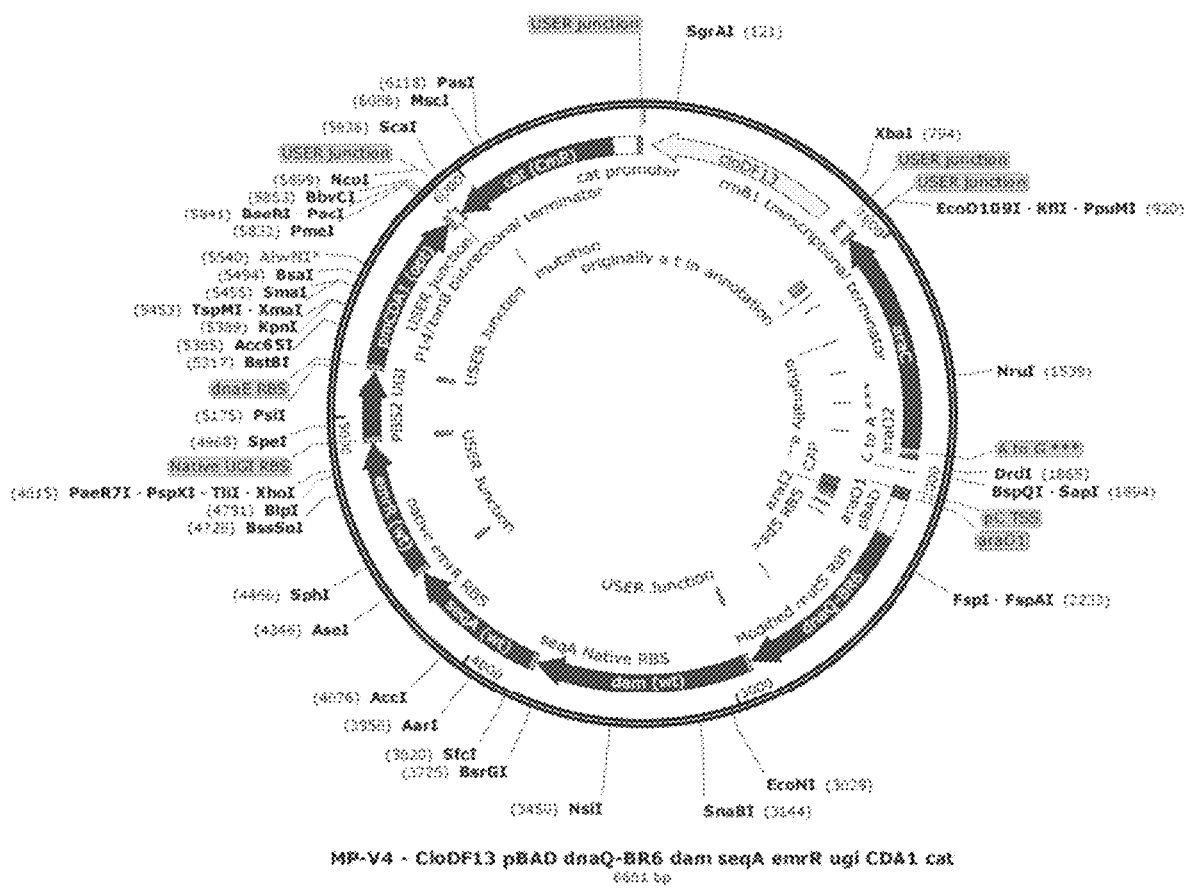
FIG. 105. MP-V4 Vector Map. A schematic depiction of one embodiment of a MP-V4 mutagenesis vector is provided, referenced herein as SEQ ID NO: 122. This embodiment comprises araC, dnaQ-BR6, dam, seqA, emrR, ugi and pmCDA1.
Figure 106:
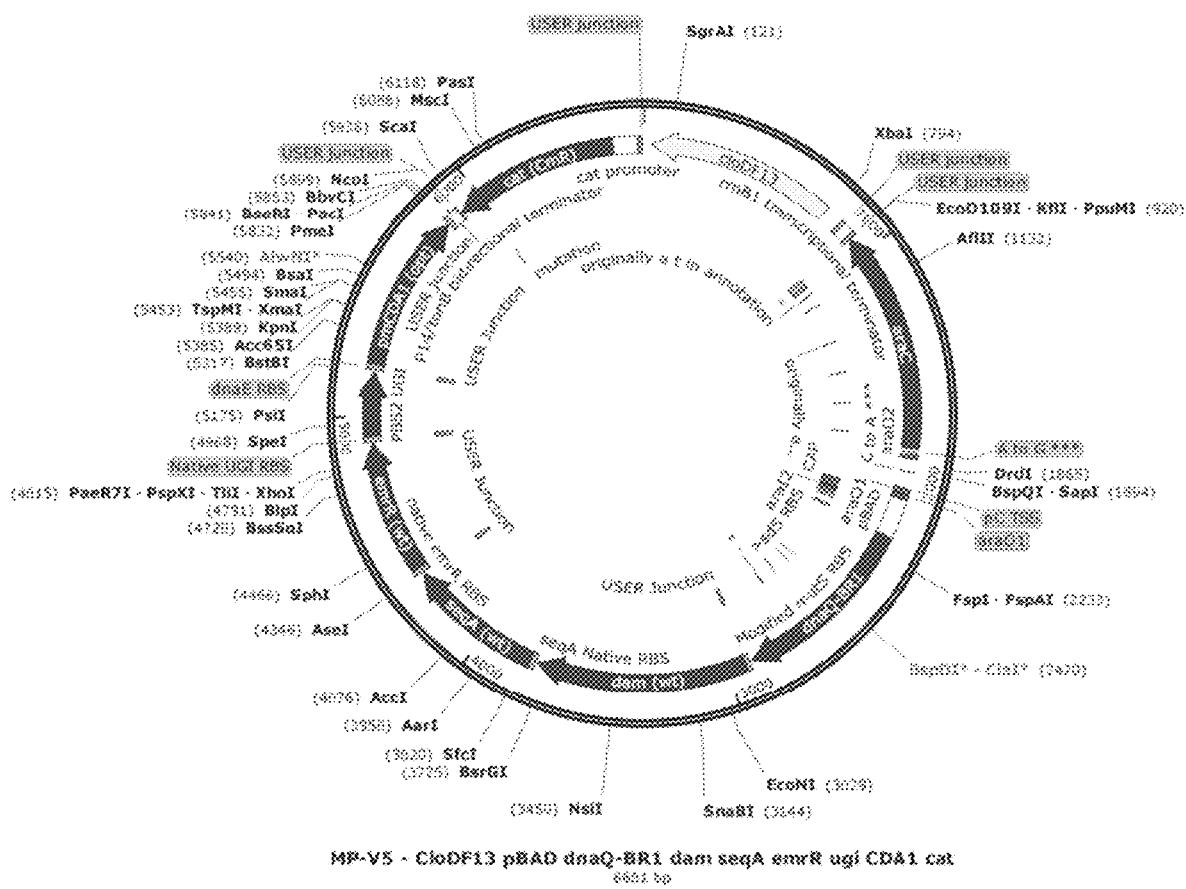
FIG. 106. MP-V5 Vector Map. A schematic depiction of one embodiment of a MP-V5 mutagenesis vector is provided, referenced herein as SEQ ID NO: 123. This embodiment comprises araC, dnaQ-BR1, dam, seqA, emrR, ugi and pmCDA1.

The sequences for exemplary, non-limiting embodiments of drift plasmids, named Drift Plasmids 1-6 (DP 1-6), comprising exemplary drift expression constructs, are provided herein. Table 7 shows the coding DNA sequence (CDS) information for exemplary DP plasmids DP1-6. FIGS. 20-25 provide vector maps of drift plasmids DP1-DP6 (SEQ ID NOs: 27-29, 33-35), respectively. It should be understood that mutagenesis plasmids depicted in FIGS. 26-106, corresponding to SEQ ID NOs: 43-123, can be modified to function as drift plasmids by the inclusion of an anhydrotetracycline (ATc)-dependent drift promoter (e.g., SEQ ID NO: 124) in the construct.

TABLE 7

Coding DNA sequence (CDS) information for exemplary DP plasmids

| CDS | DP1 | DP2 | DP3 | DP4 | DP5 | DP6 |
| --- | --- | --- | --- | --- | --- | --- |
| araC | 2885-3763 | 2885-3763 | 2885-3763 | 2885-3763 | 2885-3763 | 2885-3763 |
| dnaQ926 | 4124-4855 | 4124-4855 | 4124-4855 | 4124-4855 | 4124-4855 | 4124-4855 |
| umuD | 4893-5240 | — | — | — | — | — |
| umuC | 5243-6523 | — | — | — | — | — |
| recA730 | 6587-7648 | — | — | — | — | — |
| dam | — | — | 4884-5720 | 4884-5720 | 4884-5720 | 4884-5720 |
| seqA | — | — | — | 5749-6294 | 5749-6294 | 5749-6294 |
| emrR | — | — | — | — | — | 6323-6853 |
| PBS2 UGI | — | — | — | — | 6323-6577 | 6882-7136 |
| pmCDA1 | — | — | — | — | 6607-7233 | 7166-7792 |

| DP1 | |
| --- | --- |
| LOCUS pJC184 | 6537 bp DNA circular |
| FEATURES | Location/Qualifiers |
| modified_base | 852..866 |
| | /note="USER junction" |
| terminator | 867..911 |
| | /note="rrnB1 transcriptional terminator" |
| modified_base | 919..933 |
| | /note="USER junction" |
| misc_feature | 926..932 |
| | /note="SanDI" |
| | /note="can be used to exchange f1 origin or selection components" |
| rep_origin | complement(39..777) |
| | /dnas_title="cloDF13" |
| | /vntifkey="33" |
| | /label=cloDF13 |
| terminator | complement(7673..7708) |
| | /note="P14/tonB bidirectional terminator" |
| | /note="termination of cat transcript is slightly weaker than in opposite direction" |
| modified_base | 7709..7721 |
| | /note="USER junction" |
| CDS | complement(7722..8381) |
| | /note="cat (CmR)" |
| | /note="from pACYCDuet-1" |
| modified_base | 7797..7797 |
| | /note="mutation" |
| | /note="annotated as a G in pACYCDuet cat marker annotation, here it is an A, but this mutation is silent from codon GTC (Val, 25% codon usage) to GTT (Val, 21% usage), so it should not be of functional relevance" |
| misc_feature | 7666..7672 |
| | /note="Nt-BbvCI" |
| | /note="nicking endonuclease site that generates overhang" |
| modified_base | 7649..7665 |
| | /note="USER junction" |

-continued

| DP1 | |
|---|---|
| LOCUS pJC184 | 6537 bp DNA circular |
| FEATURES | Location/Qualifiers |

| | |
|---|---|
| misc_feature | 7651..7658 |
| | /note="PacI" |
| | /note="can be used to exchange antibiotic resistance marker or selection components" |
| promoter | 8382..8479 |
| | /note="cat promoter" |
| | /note="from pACYCDuet-1" |
| modified_base | 8480..8495 |
| | /note="USER junction" |
| misc_feature | 8481..8493 |
| | /note="SfiI" |
| | /note="can be used to exchange plasmid origin or antibiotic resistance marker" |
| CDS | complement(2885..3763) |
| | /dnas_title="araC" |
| | /vntifkey="4" |
| | /label=araC |
| misc_feature | 2885..2925 |
| promoter | complement(3429..3446) |
| | /dnas_title="SeqaraC01" |
| | /vntifkey="30" |
| | /label=SeqaraC01 |
| misc_feature | 3861..3861 |
| | /dnas_title="C to A ***" |
| | /vntifkey="21" |
| | /label=C to A *** |
| misc_feature | 3779-3779 |
| | /dnas_title="A to G ***" |
| | /vntifkey="21" |
| | /label=A to G *** |
| promoter | 3914..4066 |
| | /dnas_title="pBAD" |
| | /vntifkey="30" |
| | /label=pBAD |
| CDS | 4124..4855 |
| | /dnas_title="dnaQ926" |
| | /vntifkey="4" |
| | /label=dnaQ926 |
| promoter | complement(4353..4371) |
| | /dnas_title="dnaQ02" |
| | /vntifkey="30" |
| | /label=dnaQ02 |
| promoter | complement(4839..4853) |
| | /dnas_title="SeqdnaQ03" |
| | /vntifkey="30" |
| | /label=SeqdnaQ03 |
| CDS | 4893..5240 |
| | /dnas_title="umuD'" |
| | /vntifkey="4" |
| | /label=umuD' |
| CDS | 5243..6523 |
| | /dnas_title="umuC" |
| | /vntifkey="4" |
| | /label=umuC |
| CDS | 6587..764S |
| | /dnas_title="recA730" |
| | /vntifkey="4" |
| | /label=recA730 |
| misc_feature | 7610..7648 |
| | /note="" |
| misc_feature | 2936-2936 |
| | /note="originally an 'a' in annotation" |
| misc_feature | 2975..2975 |
| | /note="originally a t in annotation" |
| misc_feature | 3041..3041 |
| | /note="originally an a in annotation" |
| misc_feature | 3245..3245 |
| | /note="originally a c in annotation" |
| misc_feature | 3410..3410 |
| | /note="originally an a in annotation" |
| misc_feature | 3569..3569 |
| | /note="originally a g in annotation" |
| misc_feature | 3716..3716 |
| | /note="originally a g in annotation" |

-continued

| DP1 | |
|---|---|
| LOCUS pJC184 | 6537 bp DNA circular |
| FEATURES | Location/Qualifiers |
| misc_feature | 6925..6925 |
| | /note="c in originally annotation" |
| misc_feature | 4051..4051 |
| | /note="" |
| misc_feature | 4037..4037 |
| | /note="" |
| primer_bind | 39..63 |
| | /note="AB711" |
| primer_bind | 164..189 |
| | /note="AB712" |
| primer_bind | 3388..3409 |
| | /note="AB713" |
| primer_bind | 3266..3287 |
| | /note="AB714" |
| primer_bind | 4653..4676 |
| | /note="AB715" |
| primer_bind | 4530..4554 |
| | /note="AB716" |
| primer_bind | 5945..5968 |
| | /note="AB717" |
| primer_bind | 5811..5833 |
| | /note="AB718" |
| primer_bind | 7213..7235 |
| | /note="AB719" |
| primer_bind | 7079..7101 |
| | /note="AB720" |
| CDS | complement(934..2208) |
| | /dnas_title="III" |
| | /vntifkey="4" |
| | /label=III |
| misc_feature | complement(1021..1066) |
| | /note="modified to remove internal promoter" |
| primer_bind | 1060..1085 |
| | /note="AB691" |
| primer_bind | 1234..1254 |
| | /note="AB424" |
| primer_bind | 1094..1114 |
| | /note="AB423" |
| misc_feature | 2423..2435 |
| | /note="USER linker" |
| RBS | complement(2209..2222) |
| | /note="sd8 RBS (from Ringquist and Gold Mol. Micro. 1992)" |
| modified_base | complement(2223..2237) |
| | /note="USER junction" |
| misc_feature | complement(2229..2236) |
| | /note="SbfI" |
| misc_feature | complement(2224..2229) |
| | /note="BsgI" |
| misc_feature | complement(2317..2324) |
| | /note="" |
| misc_feature | complement(2308..2312) |
| | /note="" |
| misc_feature | complement(2297..2297) |
| | /note="" |
| primer_bind | complement(2305..2345) |
| | /note="" |
| primer_bind | 2266..2324 |
| | /note="" |
| protein_bind | complement(2278..2296) |
| | /note="tetR binding site" |
| terminator | complement(2443..2867) |
| | /note="rrnB1 transcriptional terminator" |
| primer_bind | 2489..2511 |
| | /note="AB428" |
| primer_bind | 2240..2267 |
| | /note="AB721" |
| misc_feature | 2868..2884 |
| | /note="USER linker" |
| modified_base | 789..806 |
| | /note="User Junction" |

-continued

| DP1 |
|---|
| LOCUS pJC184 6537 bp DNA circular |
| FEATURES Location/Qualifiers |

| | |
|---|---|
| primer_bind | 789..818 |
| | /note="" |
| primer_bind | complement(2847..2884) |
| | /note="" |
| primer_bind | 2868..2912 |
| | /note="" |
| primer_bind | complement(777..806) |
| | /note="" |
| misc_difference | 912..918 |
| | /note="cloning scar" |
| source | 1..8495 |

(SEQ ID NO: 27)

```
   1 cactcggtcg ctacgctccg ggcgtgagac tgcggcgggc gctgcggaca catacaaagt
  61 tacccacaga ttccgtggat aagcagggga ctaacatgtg aggcaaaaca gcagggccgc
 121 gccggtggcg ttttccata ggctccgccc tcctgccaga gttcacataa acagacgctt
 181 ttccggtgca tctgtgggag ccgtgaggct caaccatgaa tctgacagta cgggcgaaac
 241 ccgacaggac ttaaagatcc ccaccgtttc cggcgggtcg ctccctcttg cgctctcctg
 301 ttccgaccct gccgtttacc ggatacctgt tccgcctttc tcccttacgg aagtgtggc
 361 gctttctcat agctcacaca ctggtatctc ggctcggtgt aggtcgttcg ctccaagctg
 421 ggctgtaagc aagaactccc cgttcagccc gactgctgcg ccttatccgg taactgttca
 481 cttgagtcca acccggaaaa gcacggtaaa acgccactgg cagcagccat ggtaactgg
 541 gagttcgcag aggatttgtt tagctaaaca cgcggttgct cttgaagtgt gcgccaaagt
 601 ccggctacac tggaaggaca gatttggttg ctgtgctctg cgaaagccag ttaccacggt
 661 taagcagttc cccaactgac ttaaccttcg atcaaaccac ctccccaggt ggttttttcg
 721 tttacagggc aaaagattac gcgcagaaaa aaaggatctc aagaagatcc tttgatcttt
 781 tctactgaac cgctctagat ttcagtgcaa tttatctctt caaatgtagc acctgaagtc
 841 agcccaggag gaagaggaca tccggtcaaa taaaacgaaa ggctcagtcg aaagactggg
 901 cctttcgttt tGCTGAGGag acttagggac cctttaagac tcctattac gcagtatgtt
 961 agcaaacgta gaaaatacat acataaaggt ggcaacatat aaaagaaacg caaagacacc
1021 gcggaacagg ttgatcttat cgcagtcgat actgaactcg taaggtttac cagcgccaaa
1081 gacaaagggg cgacattcaa ccgattgagg gagggaaggt aaatattgac ggaaattatt
1141 cattaaaggt gaattatcac cgtcaccgac ttgagccatt tgggaattag agccagcaaa
1201 atcaccagta gcaccattac cattagcaag gccggaaacg tcaccaatga aaccatcgat
1261 agcagcaccg taatcagtag cgacagaatc aagtttgcct ttagcgtcag actgtagcgc
1321 gttttcatcg gcattttcgg tcatagcccc cttattagcg tttgccatct tttcataatc
1381 aaaatcaccg gaaccagagc caccaccgga accgcctccc tcagagccgc caccctcaga
1441 accgccaccc tcagagccac caccctcaga gccgccacca gaaccaccac cagagccgcc
1501 gccagcattg acaggaggtt gaggcaggtc agacgattgg ccttgatatt cacaaacgaa
1561 tggatcctca ttaaagccag aatggaaagc gcagtctctg aatttaccgt tccagtaagc
1621 gtcatacatg cttttgatg atacaggagt gtactggtaa taagttttaa cggggtcagt
1681 gccttgagta acagtgcccg tataaacagt taatgcccc tgcctatttc ggaacctatt
```

-continued

```
1741 attctgaaac atgaaagtat taagaggctg agactcctca agagaaggat taggattagc
1801 ggggttttgc tcagtaccag gcggataagt gccgtcgaga gggttgatat aagtatagcc
1861 cggaataggt gtatcaccgt actcaggagg tttagtaccg ccaccctcag aaccgccacc
1921 ctcagaaccg ccaccctcag agccaccacc ctcattttca gggatagcaa gcccaatagg
1981 aacccatgta ccgtaacact gagtttcgtc accagtacaa actacaacgc ctgtagcatt
2041 ccacagacag ccctcatagt tagcgtaacg atctaaagtt ttgtcgtctt tccagacgtt
2101 agtaaatgaa ttttctgtat ggggttttgc taaacaactt tcaacagttt cagcggagtg
2161 agaatagaaa ggaacaacta aaggaattgc gaataataat ttttcatttt ttttttttcct
2221 ttactgcacc tgcaggtaat gttgtcctct tgatttctgc gttcaggatt gtcctgctct
2281 ctatcactga tagggatgaa ctgttaatac aatttgcgtg ccaattttt atcttttga
2341 tttataaaga tctgattgaa gaatcaacag caacatgcca ggatgagtta gcgaattaca
2401 ctaacaagtg gcgaatttca tcacggagcc aatgtcctca gcgagtttgt agaaacgcaa
2461 aaaggccatc cgtcaggatg gccttctgct taatttgatg cctggcagtt tatggcgggc
2521 gtcctgcccg ccaccctccg ggccgttgct tcgcaacgtt caaatccgct cccggcggat
2581 ttgtcctact caggagagcg ttcaccgaca acaacagat aaaacgaaag gcccagtctt
2641 tcgactgagc ctttcgtttt atttgatgcc tggcagttcc ctactctcgc atggggagac
2701 cccacactac catcggcgct acggcgtttc acttctgagt tcggcatggg gtcaggtggg
2761 accaccgcgc tactgccgcc aggcaaattc tgttttatca gaccgcttct gcgttctgat
2821 ttaatctgta tcaggctgaa aatcttctct catccgccaa acagccagg gccctactga
2881 ctgtttatga caacttgacg gctacatcat tcacttttc ttcacaaccg gcacggaact
2941 cgctcgggct ggccccggtg cattttttaa ataccgcga gaaatagagt tgatcgtcaa
3001 aaccaacatt gcgaccgacg gtggcgatag gcatccgggt ggtgctcaaa agcagcttcg
3061 cctggctgat acgttggtcc tcgcgccagc ttaagacgct aatccctaac tgctggcgga
3121 aaagatgtga cagacgcgac ggcgacaagc aaacatgctg tgcgacgctg gcgatatcaa
3181 aattgctgtc tgccaggtga tcgctgatgt actgacaagc ctcgcgtacc cgattatcca
3241 tcggtggatg gagcgactcg ttaatcgctt ccatgcgccg cagtaacaat tgctcaagca
3301 gatttatcgc cagcagctcc gaatagcgcc cttcccccttg cccggcgtta atgatttgcc
3361 caaacaggtc gctgaaatgc ggctggtgcg cttcatccgg gcgaaagaac cccgtattgg
3421 caaatattga cggccagtta agccattcat gccagtaggc gcgcggacga aagtaaaccc
3481 actggtgata ccattcgcga gcctccggat gacgaccgta gtgatgaatc tctcctggcg
3541 ggaacagcaa aatatcaccc ggtcggcaaa caattctcg tccctgattt ttcaccaccc
3601 cctgaccgcg aatggtgaga ttgagaatat aacctttcat tcccagcggt cggtcgataa
3661 aaaaatcgag ataaccgttg gcctcaatcg gcgttaaacc cgccaccaga tgggcattaa
3721 acgagtatcc cggcagcagg ggatcatttt gcgcttcagc catactttc atactcccac
3781 cattcagaga agaaaccaat tgtccatatt gcatcagaca ttgccgtcac tgcgtctttt
3841 actggctctt ctcgctaacc caaccggtaa ccccgcttat taaaagcatt ctgtaacaaa
3901 gcgggaccaa agccatgaca aaaacgcgta acaaaagtgt ctataatcac ggcagaaaag
3961 tccacattga ttatttgcac ggcgtcacac tttgctatgc catagcattt ttatccataa
4021 gattagcgga tcctacctga cgctttttat cgcaactctc tactgttcct ccatacccgt
4081 ttttttggac gcgtacaact caagtctgac ataaatgacc gctatgagca ctgcaattac
4141 acgccagatc gttctcgcta ccgcaaccac cggtatgaac cagattggtg cgcactatga
```

-continued

```
4201  aggccacaag atcattgaga ttggtgccgt tgaagtggtg aaccgtcgcc tgacgggcaa
4261  taacttccat gtttatctca aacccgatcg gctggtggat ccggaagcct ttggcgtaca
4321  tggtattgcc gatgaatttt tgctcgataa gcccacgttt gccgaagtag ccgatgagtt
4381  catggactat attcgcggcg cggagttggt gatccataac gcagcgttcg atatcggctt
4441  tatggactac gagttttcgt tgcttaagcg cgatattccg aagaccaata ctttctgtaa
4501  ggtcaccgat agccttgcgg tggcgaggaa aatgtttccc ggtaagcgca acagcctcga
4561  tgcgttatgt gctcgctacg aaatagataa cagtaaacga acgctgcacg gggcattact
4621  cgatgcccag atccttgcgg aagtttatct ggcgatgacc ggtggtcaaa cgtcgatggc
4681  ttttgcgatg aaggagaga cacaacagca acaaggtgaa gcaacaattc agcgcattgt
4741  acgtcaggca agtaagttac gcgttgtttt tgcgacagat gaagagattg cagctcatga
4801  agcccgtctc gatctggtgc agaagaaagg cggaagttgc ctctggcgag cataaaccgg
4861  tatgcctcac acaggaaaca gaattcatta ccatgggctt tccttcaccg gcagcagatt
4921  acgttgaaca gcgcatcgat ctgaatcaac tgttgatcca gcatcccagc gcgacttact
4981  tcgtcaaagc aagtggtgat tctatgattg atggtggaat tagtgacggg gatttactga
5041  ttgtcgatag cgctattacc gccagccatg gtgatattgt catcgctgct gttgacggcg
5101  agtttacggt gaaaaaattg caactacgcc cgacggtaca gcttattccc atgaacagcg
5161  cgtactcgcc cattaccatc agtagtgaag atacgctgga tgtctttggt gtggtgatcc
5221  acgtcgttaa ggcgatgcgc tgatgtttgc cctctgtgat gtaaacgcgt tttatgccag
5281  ctgtgagacg gtgtttcgcc ctgatttatg gggtaaaccg gtggttgtgc tatcgaataa
5341  tgacggttgc gttatcgccc gaaacgctga ggcaaaggcg cttggcgtta aatgggcga
5401  tccctggttc aaacaaaaag atctgtttcg tcgctgtggc gtggtttgct ttagcagcaa
5461  ttatgagctt tacgcagaca tgagcaatcg ggtgatgtcg acgctggaag agctatcgcc
5521  ccgcgtcgag atttacagta ccggtatgcc tattgatgag gcattctgcg atctgacagg
5581  tgtgcgtaat tgtcgcgatc tgactgattt tggcagagaa attcgcgcaa cggtgctaca
5641  acgtacccat cttactgttg gtgtggggat cgcccagacc aaaacgctgg ctaagcttgc
5701  caatcatgcg gcaaaaaaat ggcagcggca gacgggtggg gtggtggatt tatcaaatct
5761  ggaacgccag cgtaaattaa tgtctgctct ccccgtggat gacgtctggg ggattggacg
5821  gcggatcagc aaaaaactgg acgcgatggg gatcaaaacc gttctcgatt tggcggatac
5881  agatatccgg tttatccgta aacattttaa tgtcgtgctc gaaagaacgt gcgtgaact
5941  gcgcggcgaa ccctgtttgc aactggaaga gtttgcaccg acgaagcagg aaattatctg
6001  ttcccgctcg tttggtgaac gcatcacgga ttatccgtcg atgcggcagg ccatttgtag
6061  ttacgctgcc cgggcggcgg aaaaacttcg cagcgagcat caatattgtc gattaatttc
6121  cacgtttatt aagacgtcac catttgcgct caatgaacct tattacggca atagcgcgtc
6181  ggtaaaactg ctgacgccca ctcaggacag cagggatatc attaacgctg ctacgcgatc
6241  tctggatgcc atctggcaag cgggccatcg ttaccaaaaa gcgggcgtga tgctggggga
6301  tttcttcagt cagggagtcg cgcagctcaa tttattcgat gacaacgcac gcgcccgg
6361  gagtgagcaa ttgatgacgg taatggatac actgaatgct aaagagggca gaggaacact
6421  ctattttgcc gggcaggga tccagcaaca atggcagatg aagcgagcca tgctttcacc
6481  acgttataca acgcgaagtt ctgattact gagggtcaaa taaatatagc ggcaggaaaa
6541  aagcgatccc gcatatccgg tattacccgg catgacagga gtaaaaatgg ctatcgacga
```

-continued

```
6601 aaacaaacag aaagcgttgg cggcagcact gggccagatt gagaaacaat ttggtaaagg 6661 ctccatcatg cgcctgggtg aagaccgttc catggatgtg aaaaccatct ctaccggttc 6721 gctttcactg gatatcgcgc ttggggcagg tggtctgccg atgggccgta tcgtcgaaat 6781 ctacggaccg gaatcttccg gtaaaaccac gctgacgctg caggtgatcg ccgcagcgca 6841 gcgtgaaggt aaaacctgtg cgtttatcga tgctgaacac gcgctggacc caatctacgc 6901 acgtaaactg ggcgtcgata tcgataacct gctgtgctcc cagccggaca ccggcgagca 6961 ggcactggaa atctgtgacg ccctggcgcg ttctggcgca gtagacgtta tcgtcgttga 7021 ctccgtggcg gcactgacgc cgaaagcgga aatcgaaggc gaaatcggcg actctcacat 7081 gggccttgcg gcacgtatga tgagccaggc gatgcgtaag ctggcgggta acctgaagca 7141 gtccaacacg ctgctgatct tcatcaacca gatccgtatg aaaattggtg tgatgttcgg 7201 taacccggaa accactaccg gtggtaacgc gctgaaattc tacgcctctg ttcgtctcga 7261 catccgtcgt atcggcgcgg tgaaagaggg cgaaaacgtg gtgggtagcg aaacccgcgt 7321 gaaagtggtg aagaacaaaa tcgctgcgcc gtttaaacag gctgaattcc agatcctcta 7381 cggcgaaggt atcaacttct acggcgaact ggttgacctg gcgtaaaag agaagctgat 7441 cgagaaagca ggcgcgtggt acagctacaa aggtgagaag atcggtcagg gtaaagcgaa 7501 tgcgactgcc tggctgaaag ataacccgga aaccgcgaaa gagatcgaga agaaagtacg 7561 tgagttgctg ctgagcaacc cgaactcaac gccggatttc tctgtagatg atagcgaagg 7621 cgtagcagaa actaacgaag attttttaaac ttaattaacg gcactcctca gccaagtcaa 7681 aagcctccga ccggaggctt ttgactacat gcccatggcg tttacgcccc gccctgccac 7741 tcatcgcagt actgttgtaa ttcattaagc attctgccga catggaagcc atcacaaacg 7801 gcatgatgaa cctgaatcgc cagcggcatc agcaccttgt cgccttgcgt ataatatttg 7861 cccatagtga aaacgggggc gaagaagttg tccatattgg ccacgtttaa atcaaaactg 7921 gtgaaactca cccagggatt ggctgagacg aaaaacatat tctcaataaa cccctttaggg 7981 aaataggcca ggttttcacc gtaacacgcc acatcttgcg aatatatgtg tagaaactgc 8041 cggaaatcgt cgtggtattc actccagagc gatgaaaacg tttcagtttg ctcatggaaa 8101 acggtgtaac aagggtgaac actatcccat atcaccagct caccgtcttt cattgccata 8161 cggaactccg gatgagcatt catcaggcgg gcaagaatgt gaataaaggc cggataaaac 8221 ttgtgcttat ttttctttac ggtctttaaa aaggccgtaa tatccagctg aacggtctgg 8281 ttataggtac attgagcaac tgactgaaat gcctcaaaat gttctttacg atgccattgg 8341 gatatatcaa cggtggtata tccagtgatt ttttctcca ttttagcttc cttagctcct 8401 gaaaatctcg ataactcaaa aaatacgccc ggtagtgatc ttatttcatt atggtgaaag 8461 ttggaacctc ttacgtgcca Agccaaatag gccgt
```

DP2

LOCUS   pJC184   6537 bp   DNA   circular
FEATURES   Location/Qualifiers

| Feature | Location/Qualifiers |
|---|---|
| modified_base | 852..866 |
| | /note="USER junction" |
| terminator | 867..911 |
| | /note="rrnB1 transcriptional terminator" |
| modified_base | 919..933 |
| | /note="USER junction" |
| rep_origin | complement(39..777) |
| | /dnas_title="cloDF13" |
| | /vntifkey="33" |
| | /label=cloDF13 |
| terminator | complement(7817..7852) |
| | /note="P14/tonB bidirectional terminator" |
| | /note="termination of cat transcript is slightly weaker than in opposite direction" |
| modified_base | 7853..7865 |
| | /note="USER junction" |
| CDS | complement(7866..8525) |
| | /note="cat (CmR)" |
| | /note="from pACYCDuet-1" |
| modified_base | 7941..7941 |
| | /note="mutation" |
| | /note="annotated as a G in pACYCDuet cat marker annotation, here it is an A, but this mutation is silent from codon GTC (Val, 25% codon usage) to GTT (Val, 21% usage), so it should not be of functional relevance" |
| promoter | 8526..8623 |
| | /note="cat promoter" |
| | /note="from pACYCDuet-1" |
| modified_base | 8624..8639 |
| | /note="USER junction" |
| CDS | complement(2885..3763) |
| | /dnas_title="araC" |
| | /vntifkey="4" |
| | /label=araC |
| misc_feature | 2936..2936 |
| | /note="originally an 'a' in annotation" |
| misc_feature | 2975..2975 |
| | /note="originally a t in annotation" |
| misc_feature | 3041..3041 |
| | /note="originally an a in annotation" |
| misc_feature | 3245..3245 |
| | /note="originally a c in annotation" |
| misc_feature | 3410..3410 |
| | /note="originally an a in annotation" |
| misc_feature | 3569..3569 |
| | /note="originally a g in annotation" |
| misc_feature | 3716..3716 |
| | /note="originally a g in annotation" |
| CDS | complement(934..2208) |
| | /dnas_title="III" |
| | /vntifkey="4" |
| | /label=III |
| misc_feature | complement(1021..1066) |
| | /note="modified to remove internal promoter" |
| misc_feature | 2423..2435 |
| | /note="USER linker" |
| RBS | complement(2209..2222) |
| | /note="sd8 RBS (from Ringquist and Gold Mol. Micro. 1992)" |
| modified_base | complement(2223..2237) |
| | /note="USER junction" |
| terminator | complement(2443..2867) |
| | /note="rrnB1 transcriptional terminator" |
| misc_feature | 2868..2884 |
| | /note="USER linker" |
| modified_base | 789..806 |
| | /note="User Junction" |
| misc_difference | 912..918 |
| | /note="cloning scar" |
| protein_bind | complement(2408..2422) |
| | /note="UAS II" |
| protein_bind | complement(2386..2404) |
| | /note="UAS I" |
| prim_transcript | complement(2297..2297) |
| | /note="Transcription Start Site" |
| enhancer | complement(2375..2422) |
| | /note="Protected by pspF" |
| RBS | complement(2406..2415) |
| | /note="pspF RBS" |
| promoter | 2356..2384 |
| | /note="pspF P1" |
| promoter | 2375..2402 |
| | /note="pspF P2" |
| promoter | 2242..2269 |
| | /note="pspF P3" |
| -35_signal | 2242..2247 |
| | /note="-35" |
| -10_signal | 2264..2269 |
| | /note="-10" |
| -35_signal | 2356..2361 |
| | /note="-35" |
| -35_signal | 2375..2380 |
| | /note="-35" |
| -10_signal | 2379..2384 |
| | /note="-10" |
| -10_signal | 2397..2402 |
| | /note="-10" |
| prim_transcript | 2276..2276 |
| | /note="" |
| prim_transcript | 2390..2390 |
| | /note="" |
| prim_transcript | 2406..2406 |
| | /note="" |
| promoter | complement(2308..2324) |
| | /note="Sigma54 Core Promoter" |
| -35_signal | complement(2321..2322) |
| | /note="-24" |
| -10_signal | complement(2309..2310) |
| | /note="-12" |
| protein_bind | complement(2326..2358) |
| | /note="High Affinity IHF Site" |
| protein_bind | complement(2278..2296) |
| | /note="tetR binding site" |
| misc_feature | 3861..3861 |
| | /dnas_title="C to A ***" |
| | /vntifkey="21" |
| | /label=C to A *** |
| misc_feature | 3779..3779 |
| | /dnas_title="A to G ***" |
| | /vntifkey="21" |
| | /label=A to G *** |
| prim_transcript | complement(3927..3927) |
| | /note="pC TSS" |
| protein_bind | 3950..3966 |
| | /note="araO1" |
| protein_bind | 3929..3945 |
| | /note="araO1" |
| protein_bind | 3792..3808 |
| | /note="araO2" |
| protein_bind | 3971..3992 |
| | /note="CAP" |
| misc_feature | 4051..4051 |
| | /note="" |
| misc_feature | 4037..4037 |
| | /note="" |
| prim_transcript | 4075..4075 |
| | /note="pBAD TSS" |
| protein_bind | 4003..4019 |
| | /note="araI1" |
| protein_bind | 4024..4040 |
| | /note="araI2" |
| -10_signal | 4061..4066 |
| | /note="-10" |
| -35_signal | 4037..4042 |
| | /note="-35" |
| promoter | 3971..4100 |
| | /dnas_title="pBAD" |
| | /vntifkey="30" |
| | /label=pBAD |

DP2

| LOCUS pJC184 | 6537 bp DNA circular |
|---|---|
| FEATURES | Location/Qualifiers |
| RBS | 4104..4123 |
| | /note="Native dnaQ RBS" |
| CDS | 4124..4855 |
| | /dnas_title="dnaQ926" |
| | /vntifkey="4" |
| | /label=dnaQ926 |
| conflict | 4157..4159 |
| | /note="D12A" |
| conflict | 4163..4165 |
| | /note="E14A" |
| RBS | 4865..4883 |
| | /note="Modified mutS RBS" |
| modified_base | 4865..4878 |
| | /note="USER Junction" |
| CDS | 4884..5720 |
| | /note="dam (wt)" |
| CDS | 5749..6294 |
| | /note="seqA (wt)" |
| RBS | 5729..5748 |
| | /note="seqA Native RBS" |

DP2

| LOCUS pJC184 | 6537 bp DNA circular |
|---|---|
| FEATURES | Location/Qualifiers |
| CDS | 6323..6853 |
| | /note="emrR (wt)" |
| RBS | 6303..6322 |
| | /note="native emrR RBS" |
| modified_base | 6275..6292 |
| | /note="USER Junction" |
| CDS | 6882..7136 |
| | /note="PBS2 UGI" |
| RBS | 6861..6881 |
| | /note="Native UGI RBS" |
| modified_base | 6858..6877 |
| | /note="USER Junction" |
| RBS | 7145..7165 |
| | /note="dnaE RBS" |
| modified_base | 7141..7159 |
| | /note="USER Junction" |
| CDS | 7166..7792 |
| | /note="pmCDA1 (opt)" |
| modified_base | 7793..7809 |
| | /note="USER junction" |
| source | 1..5702 |

(SEQ ID NO: 28)

```
   1 cactcggtcg ctacgctccg ggcgtgagac tgcggcgggc gctgcggaca catacaaagt
  61 tacccacaga ttccgtggat aagcagggga ctaacatgtg aggcaaaaca gcagggccgc
 121 gccggtggcg tttttccata ggctccgccc tcctgccaga gttcacataa acagacgctt
 181 ttccggtgca tctgtgggag ccgtgaggct caaccatgaa tctgacagta cgggcgaaac
 241 ccgacaggac ttaaagatcc ccaccgtttc cggcgggtcg ctccctcttg cgctctcctg
 301 ttccgaccct gccgtttacc ggatacctgt tccgcctttc tcccttacgg gaagtgtggc
 361 gctttctcat agctcacaca ctggtatctc ggctcggtgt aggtcgttcg ctccaagctg
 421 ggctgtaagc aagaactccc cgttcagccc gactgctgcg ccttatccgg taactgttca
 481 cttgagtcca acccggaaaa gcacggtaaa acgccactgg cagcagccat tggtaactgg
 541 gagttcgcag aggatttgtt tagctaaaca cgcggttgct cttgaagtgt gcgccaaagt
 601 ccggctacac tggaaggaca gatttggttg ctgtgctctg cgaaagccag ttaccacggt
 661 taagcagttc cccaactgac ttaaccttcg atcaaaccac ctccccaggt ggttttttcg
 721 tttacagggc aaaagattac gcgcagaaaa aaaggatctc aagaagatcc tttgatcttt
 781 tctactgaac cgctctagat ttcagtgcaa tttatctctt caaatgtagc acctgaagtc
 841 agcccaggag gaagaggaca tccggtcaaa taaaacgaaa ggctcagtcg aaagactggg
 901 cctttcgttt tGCTGAGGag acttagggac cctttaagac tccttattac gcagtatgtt
 961 agcaaacgta gaaaatacat acataaaggt ggcaacatat aaaagaaacg caaagacacc
1021 gcggaacagg ttgatcttat cgcagtcgat actgaactcg taaggtttac cagcgccaaa
1081 gacaaagggc gacattcaa ccgattgagg gagggaaggt aaatattgac ggaaattatt
1141 cattaaaggt gaattatcac cgtcaccgac ttgagccatt tgggaattag agccagcaaa
1201 atcaccagta gcaccattac cattagcaag gccggaaacg tcaccaatga aaccatcgat
1261 agcagcaccg taatcagtag cgacagaatc aagtttgcct ttagcgtcag actgtagcgc
1321 gttttcatcg gcattttcgg tcatagcccc cttattagcg tttgccatct tttcataatc
1381 aaaatcaccg gaaccagagc caccaccgga accgcctccc tcagagccgc caccctcaga
```

-continued

```
1441 accgccaccc tcagagccac caccctcaga gccgccacca gaaccaccac cagagccgcc 1501 gccagcattg acaggaggtt gaggcaggtc agacgattgg ccttgatatt cacaaacgaa 1561 tggatcctca ttaaagccag aatggaaagc gcagtctctg aatttaccgt tccagtaagc 1621 gtcatacatg gcttttgatg atacaggagt gtactggtaa taagttttaa cggggtcagt 1681 gccttgagta acagtgcccg tataaacagt taatgccccc tgcctatttc ggaacctatt 1741 attctgaaac atgaaagtat taagaggctg agactcctca agagaaggat taggattagc 1801 ggggttttgc tcagtaccag gcggataagt gccgtcgaga gggttgatat aagtatagcc 1861 cggaataggt gtatcaccgt actcaggagg tttagtaccg ccaccctcag aaccgccacc 1921 ctcagaaccg ccaccctcag agccaccacc ctcatttca gggatagcaa gcccaatagg 1981 aacccatgta ccgtaacact gagtttcgtc accagtacaa actacaacgc ctgtagcatt 2041 ccacagacag ccctcatagt tagcgtaacg atctaaagtt ttgtcgtctt tccagacgtt 2101 agtaaatgaa ttttctgtat ggggttttgc taaacaactt tcaacagttt cagcggagtg 2161 agaatagaaa ggaacaacta aaggaattgc gaataataat tttttcattt ttttttcct 2221 ttactgcacc tgcaggtaat gttgtcctct tgatttctgc gttcaggatt gtcctgctct 2281 ctatcactga tagggatgaa ctgttaatac aatttgcgtg ccaatttttt atcttttga 2341 tttataaaga tctgattgaa gaatcaacag caacatgcca ggatgagtta gcgaattaca 2401 ctaacaagtg gcgaatttca tcacggagcc aatgtcctca gcgagtttgt agaaacgcaa 2461 aaaggccatc cgtcaggatg gccttctgct taatttgatg cctggcagtt tatggcgggc 2521 gtcctgcccg ccaccctccg ggccgttgct tcgcaacgtt caaatccgct cccggcggat 2581 ttgtcctact caggagagcg ttcaccgaca acaacagat aaaacgaaag gcccagtctt 2641 tcgactgagc ctttcgtttt atttgatgcc tggcagttcc ctactctcgc atggggagac 2701 cccacactac catcggcgct acggcgtttc acttctgagt tcggcatggg gtcaggtggg 2761 accaccgcgc tactgccgcc aggcaaattc tgttttatca gaccgcttct gcgttctgat 2821 ttaatctgta tcaggctgaa atcttctct catccgccaa acagccagg gccctactga 2881 ctgtttatga caacttgacg gctacatcat tcactttttc ttcacaaccg gcacggaact 2941 cgctcgggct ggccccggtg cattttttaa atacccgcga gaaatagagt tgatcgtcaa 3001 aaccaacatt gcgaccgacg gtggcgatag gcatccgggt ggtgctcaaa agcagcttcg 3061 cctggctgat acgttggtcc tcgcgccagc ttaagacgct aatccctaac tgctggcgga 3121 aaagatgtga cagacgcgac ggcgacaagc aaacatgctg tgcgacgctg gcgatatcaa 3181 aattgctgtc tgccaggtga tcgctgatgt actgacaagc ctcgcgtacc cgattatcca 3241 tcggtggatg gagcgactcg ttaatcgctt ccatgcgccg cagtaacaat tgctcaagca 3301 gatttatcgc cagcagctcc gaatagcgcc cttcccttg cccggcgtta atgatttgcc 3361 caaacaggtc gctgaaatgc ggctggtgcg cttcatccgg gcgaaagaac cccgtattgg 3421 caaatattga cggccagtta agccattcat gccagtaggc gcgcggacga agtaaaccc 3481 actggtgata ccattcgcga gcctccggat gacgaccgta gtgatgaatc tctcctggcg 3541 ggaacagcaa atatcaccc ggtcggcaaa caaattctcg tccctgattt ttcaccaccc 3601 cctgaccgcg aatggtgaga ttgagaatat aaccttcat tcccagcggt cggtcgataa 3661 aaaaatcgag ataaccgttg gcctcaatcg gcgttaaacc cgccaccaga tgggcattaa 3721 acgagtatcc cggcagcagg ggatcatttt gcgcttcagc catactttc atactcccac 3781 cattcagaga agaaaccaat tgtccatatt gcatcagaca ttgccgtcac tgcgtctttt 3841 actggctctt ctcgctaacc caaccggtaa ccccgcttat taaaagcatt ctgtaacaaa
```

```
3901 gcgggaccaa agccatgaca aaaacgcgta acaaaagtgt ctataatcac ggcagaaaag 3961 tccacattga ttatttgcac ggcgtcacac tttgctatgc catagcattt ttatccataa 4021 gattagcgga tcctacctga cgctttttat cgcaactctc tactgtttct ccatacccgt 4081 ttttttggac gcgtacaact caagtctgac ataaatgacc gctatgagca ctgcaattac 4141 acgccagatc gttctcgcta ccgcaaccac cggtatgaac cagattggtg cgcactatga 4201 aggccacaag atcattgaga ttggtgccgt tgaagtggtg aaccgtcgcc tgacgggcaa 4261 taacttccat gtttatctca aacccgatcg gctggtggat ccggaagcct ttggcgtaca 4321 tggtattgcc gatgaatttt gctcgataa gcccacgttt gccgaagtag ccgatgagtt 4381 catggactat attcgcggcg cggagttggt gatccataac gcagcgttcg atatcggctt 4441 tatggactac gagttttcgt tgcttaagcg cgatattccg aagaccaata ctttctgtaa 4501 ggtcaccgat agccttgcgg tggcgaggaa aatgtttccc ggtaagcgca acagcctcga 4561 tgcgttatgt gctcgctacg aaatagataa cagtaaacga acgctgcacg gggcattact 4621 cgatgcccag atccttgcgg aagtttatct ggcgatgacc ggtggtcaaa cgtcgatggc 4681 ttttgcgatg gaaggagaga cacaacagca acaaggtgaa gcaacaattc agcgcattgt 4741 acgtcaggca agtaagttac gcgttgtttt tgcgacagat gaagagattg cagctcatga 4801 agcccgtctc gatctggtgc agaagaaagg cggaagttgc ctctggcgag cataaactta 4861 attaacggca ctcctcagcc aagtcaaaag cctccgaccg gaggcttttg actacatgcc 4921 catggcgttt acgcccgcc ctgccactca tcgcagtact gttgtaattc attaagcatt 4981 ctgccgacat ggaagccatc acaaacggca tgatgaacct gaatcgccag cggcatcagc 5041 accttgtcgc cttgcgtata atatttgccc atagtgaaaa cggggggcgaa gaagttgtcc 5101 atattggcca cgtttaaatc aaaactggtg aaactcaccc agggattggc tgagacgaaa 5161 aacatattct caataaaccc tttagggaaa taggccaggt tttcaccgta acacgccaca 5221 tcttgcgaat atatgtgtag aaactgccgg aaatcgtcgt ggtattcact ccagagcgat 5281 gaaaacgttt cagtttgctc atggaaaacg gtgtaacaag ggtgaacact atcccatatc 5341 accagctcac cgtctttcat tgccatacgg aactccggat gagcattcat caggcgggca 5401 agaatgtgaa taaaggccgg ataaaacttg tgcttatttt tctttacggt ctttaaaaag 5461 gccgtaatat ccagctgaac ggtctggtta taggtacatt gagcaactga ctgaaatgcc 5521 tcaaaatgtt ctttacgatg ccattgggat atatcaacgg tggtatatcc agtgattttt 5581 ttctccattt tagcttcctt agctcctgaa aatctcgata actcaaaaaa tacgcccggt 5641 agtgatctta tttcattatg gtgaaagttg gaacctctta cgtgccaAgc caaataggcc 5701 gt
```

| DP3 | |
|---|---|
| LOCUS pJC184 | 6537 bp DNA circular |
| FEATURES | Location/Qualifiers |
| modified_base | 852..866 |
| | /note="USER junction" |
| terminator | 867..911 |
| | /note="rrnB1 transcriptional terminator" |
| modified_base | 919..933 |
| | /note="USER junction" |
| rep_origin | complement(39..777) |
| | /dnas_title="cloDF13" |
| | /vntifkey="33" |
| | /label=cloDF13 |

-continued

| DP3 | |
|---|---|
| LOCUS pJC184 | 6537 bp DNA circular |
| FEATURES | Location/Qualifiers |
| terminator | complement(5745..5780) |
| | /note="P14/tonB bidirectional terminator" |
| | /note="termination of cat transcript is slightly weaker than in opposite direction" |
| modified_base | 5781..5793 |
| | /note="USER junction" |
| CDS | complement(5794..6453) |
| | /note="cat (CmR)" |
| | /note="from pACYCDuet-1" |

-continued

| DP3 | |
|---|---|
| LOCUS pJC184 | 6537 bp DNA circular |
| FEATURES | Location/Qualifiers |
| modified_base | 5869..5869<br>/note="mutation"<br>/note="annotated as a G in pACYCDuet cat marker annotation, here it is an A, but this mutation is silent from codon GTC (Val, 25% codon usage) to GTT (Val, 21% usage), so it should not be of functional relevance" |
| promoter | 6454..6551<br>/note="cat promoter"<br>/note="from pACYCDuet-1" |
| modified_base | 6552..6567<br>/note="USER junction" |
| CDS | complement(2885..3763)<br>/dnas_title="araC"<br>/vntifkey="4"<br>/label=araC |
| misc_feature | 2936..2936<br>/note="originally an 'a' in annotation" |
| misc_feature | 2975..2975<br>/note="originally a t in annotation" |
| misc_feature | 3041..3041<br>/note="originally an a in annotation" |
| misc_feature | 3245..3245<br>/note="originally a c in annotation" |
| misc_feature | 3410..3410<br>/note="originally an a in annotation" |
| misc_feature | 3569..3569<br>/note="originally a g in annotation" |
| misc_feature | 3716..3716<br>/note="originally a g in annotation" |
| CDS | complement(934..2208)<br>/dnas_title="III"<br>/vntifkey="4"<br>/label=III |
| misc_feature | complement(1021..1066)<br>/note="modified to remove internal promoter" |
| misc_feature | 2423..2435<br>/note="USER linker" |
| RBS | complement(2209..2222)<br>/note="sd8 RBS (from Ringquist and Gold Mol. Micro. 1992)" |
| modified_base | complement(2223..2237)<br>/note="USER junction" |
| terminator | complement(2443..2867)<br>/note="rrnB1 transcriptional terminator" |
| misc_feature | 2868..2884<br>/note="USER linker" |
| modified_base | 789..806<br>/note="User Junction" |
| misc_difference | 912..918<br>/note="cloning scar" |
| protein_bind | complement(2408..2422)<br>/note="UAS II" |
| protein_bind | complement(2386..2404)<br>/note="UAS I" |
| prim_transcript | complement(2297..2297)<br>/note="Transcription Start Site" |
| enhancer | complement(2375..2422)<br>/note="Protected by pspF" |
| RBS | complement(2406..2415)<br>/note="pspF RBS" |
| promoter | 2356..2384<br>/note="pspF P1" |
| promoter | 2375..2402<br>/note="pspF P2" |
| promoter | 2242..2269<br>/note="pspF P3" |
| −35_signal | 2242..2247<br>/note="−35" |
| −10_signal | 2264..2269<br>/note="−10" |
| −35_signal | 2356..2361<br>/note="−35" |

-continued

| DP3 | |
|---|---|
| LOCUS pJC184 | 6537 bp DNA circular |
| FEATURES | Location/Qualifiers |
| −35_signal | 2375..2380<br>/note="−35" |
| −10_signal | 2379..2384<br>/note="−10" |
| −10_signal | 2397..2402<br>/note="−10" |
| prim_transcript | 2276..2276<br>/note="" |
| prim_transcript | 2390..2390<br>/note="" |
| prim_transcript | 2406..2406<br>/note="" |
| promoter | complement(2308..2324)<br>/note="Sigma54 Core Promoter" |
| −35_signal | complement(2321..2322)<br>/note="−24" |
| −10_signal | complement(2309..2310)<br>/note="−12" |
| protein_bind | complement(2326..2358)<br>/note="High Affinity IHF Site" |
| protein_bind | complement(2278..2296)<br>/note="tetR binding site" |
| misc_feature | 3861..3861<br>/dnas_title="C to A ***"<br>/vntifkey="21"<br>/label=C to A *** |
| misc_feature | 3779..3779<br>/dnas_title="A to G ***"<br>/vntifkey="21"<br>/label=A to G *** |
| prim_transcript | complement(3927..3927)<br>/note="pC TSS" |
| protein_bind | 3950..3966<br>/note="araO1" |
| protein_bind | 3929..3945<br>/note="araO1" |
| protein_bind | 3792..3808<br>/note="araO2" |
| protein_bind | 3971..3992<br>/note="CAP" |
| misc_feature | 4051..4051<br>/note="" |
| misc_feature | 4037..4037<br>/note="" |
| prim_transcript | 4075..4075<br>/note="pBAD TSS" |
| protein_bind | 4003..4019<br>/note="araI1" |
| protein_bind | 4024..4040<br>/note="araI2" |
| −10_signal | 4061..4066<br>/note="−10" |
| −35_signal | 4037..4042<br>/note="−35" |
| promoter | 3971..4100<br>/dnas_title="pBAD"<br>/vntifkey="30"<br>/label=pBAD |
| RBS | 4104..4123<br>/note="Native dnaQ RBS" |
| CDS | 4124..4855<br>/dnas_title="dnaQ926"<br>/vntifkey="4"<br>/label=dnaQ926 |
| conflict | 4157..4159<br>/note="D12A" |
| conflict | 4163..4165<br>/note="E14A" |
| RBS | 4865..4883<br>/note="Modified mutS RBS" |

DP3

| | |
|---|---|
| LOCUS pJC184 | 6537 bp DNA circular |
| FEATURES | Location/Qualifiers |
| modified_base | 4865..4878 |
| | /note="USER Junction" |
| CDS | 4884..5720 |
| | /note="dam (wt)" |

DP3

| | |
|---|---|
| LOCUS pJC184 | 6537 bp DNA circular |
| FEATURES | Location/Qualifiers |
| modified_base | 5721..5737 |
| | /note="USER junction" |
| source | 1..6567 |

(SEQ ID NO: 29)

```
   1 cactcggtcg ctacgctccg ggcgtgagac tgcggcgggc gctgcggaca catacaaagt
  61 tacccacaga ttccgtggat aagcagggga ctaacatgtg aggcaaaaca gcagggccgc
 121 gccggtggcg ttttccata ggctccgccc tcctgccaga gttcacataa acagacgctt
 181 ttccggtgca tctgtgggag ccgtgaggct caaccatgaa tctgacagta cgggcgaaac
 241 ccgacaggac ttaaagatcc ccaccgtttc cggcgggtcg ctccctcttg cgctctcctg
 301 ttccgaccct gccgtttacc ggatacctgt tccgcctttc tcccttacgg gaagtgtggc
 361 gctttctcat agctcacaca ctggtatctc ggctcggtgt aggtcgttcg ctccaagctg
 421 ggctgtaagc aagaactccc cgttcagccc gactgctgcg ccttatccgg taactgttca
 481 cttgagtcca acccggaaaa gcacggtaaa acgccactgg cagcagccat tggtaactgg
 541 gagttcgcag aggatttgtt tagctaaaca cgcggttgct cttgaagtgt gcgccaaagt
 601 ccggctacac tggaaggaca gatttggttg ctgtgctctg cgaaagccag ttaccacggt
 661 taagcagttc cccaactgac ttaaccttcg atcaaaccac ctccccaggt ggttttttcg
 721 tttacagggc aaaagattac gcgcagaaaa aaggatctc aagaagatcc tttgatcttt
 781 tctactgaac cgctctagat ttcagtgcaa tttatctctt caaatgtagc acctgaagtc
 841 agcccaggag gaagaggaca tccggtcaaa taaaacgaaa ggctcagtcg aaagactggg
 901 cctttcgttt tGCTGAGGag acttagggac cctttaagac tccttattac gcagtatgtt
 961 agcaaacgta gaaaatacat acataaaggt ggcaacatat aaaagaaacg caaagacacc
1021 gcggaacagg ttgatcttat cgcagtcgat actgaactcg taaggtttac cagcgccaaa
1081 gacaaagggg cgacattcaa ccgattgagg gagggaaggt aaatattgac ggaaattatt
1141 cattaaaggt gaattatcac cgtcaccgac ttgagccatt tgggaattag agccagcaaa
1201 atcaccagta gcaccattac cattagcaag gccggaaacg tcaccaatga aaccatcgat
1261 agcagcaccg taatcagtag cgacagaatc aagtttgcct ttagcgtcag actgtagcgc
1321 gttttcatcg gcattttcgg tcatagcccc cttattagcg tttgccatct tttcataatc
1381 aaaatcaccg gaaccagagc caccaccgga accgcctccc tcagagccgc caccctcaga
1441 accgccaccc tcagagccac caccctcaga gccgccacca gaaccaccac cagagccgcc
1501 gccagcattg acaggaggtt gaggcaggtc agacgattgg ccttgatatt cacaaacgaa
1561 tggatcctca ttaaagccaa aatggaaagc gcagtctctg aatttaccgt tccagtaagc
1621 gtcatacatg gcttttgatg atacaggagt gtactggtaa taagttttaa cggggtcagt
1681 gccttgagta acagtgccc tataaacagt taatgccccc tgcctatttc ggaacctatt
1741 attctgaaac atgaaagtat taagaggctg agactcctca agagaaggat taggattagc
1801 ggggttttgc tcagtaccag gcggataagt gccgtcgaga gggttgatat aagtatagcc
1861 cggaataggt gtatcaccgt actcaggagg tttagtaccc caccctcag aaccgccacc
1921 ctcagaaccg ccaccctcag agccaccacc ctcatttca gggatagcaa gcccaatagg
```

```
1981  aacccatgta ccgtaacact gagtttcgtc accagtacaa actacaacgc ctgtagcatt
2041  ccacagacag ccctcatagt tagcgtaacg atctaaagtt ttgtcgtctt tccagacgtt
2101  agtaaatgaa ttttctgtat ggggttttgc taaacaactt tcaacagttt cagcggagtg
2161  agaatagaaa ggaacaacta aaggaattgc gaataataat ttttcatttt tttttttcct
2221  ttactgcacc tgcaggtaat gttgtcctct tgatttctgc gttcaggatt gtcctgctct
2281  ctatcactga tagggatgaa ctgttaatac aatttgcgtg ccaattttt atctttttga
2341  tttataaaga tctgattgaa gaatcaacag caacatgcca ggatgagtta gcgaattaca
2401  ctaacaagtg gcgaatttca tcacggagcc aatgtcctca gcgagtttgt agaaacgcaa
2461  aaaggccatc cgtcaggatg gccttctgct taatttgatg cctggcagtt tatggcgggc
2521  gtcctgcccg ccaccctccg ggccgttgct tcgcaacgtt caaatccgct cccggcggat
2581  ttgtcctact caggagagcg ttcaccgaca acaacagat aaaacgaaag gcccagtctt
2641  tcgactgagc ctttcgtttt atttgatgcc tggcagttcc ctactctcgc atggggagac
2701  cccacactac catcggcgct acggcgtttc acttctgagt tcggcatggg gtcaggtggg
2761  accaccgcgc tactgccgcc aggcaaattc tgttttatca gaccgcttct gcgttctgat
2821  ttaatctgta tcaggctgaa aatcttctct catccgccaa acagccagg cccctactga
2881  ctgtttatga caacttgacg gctacatcat tcacttttc ttcacaaccg gcacggaact
2941  cgctcgggct ggccccggtg cattttttaa atacccgcga gaatagagt tgatcgtcaa
3001  aaccaacatt gcgaccgacg gtggcgatag gcatccgggt ggtgctcaaa agcagcttcg
3061  cctggctgat acgttggtcc tcgcgccagc ttaagacgct aatccctaac tgctggcgga
3121  aaagatgtga cagacgcgac ggcgacaagc aaacatgctg tgcgacgctg gcgatatcaa
3181  aattgctgtc tgccaggtga tcgctgatgt actgacaagc ctcgcgtacc cgattatcca
3241  tcggtggatg gagcgactcg ttaatcgctt ccatgcgccg cagtaacaat tgctcaagca
3301  gatttatcgc cagcagctcc gaatagcgcc cttccccttg cccggcgtta atgatttgcc
3361  caaacaggtc gctgaaatgc ggctggtgcg cttcatccgg gcgaaagaac cccgtattgg
3421  caaatattga cggccagtta agccattcat gccagtaggc gcgcggacga aagtaaaccc
3481  actggtgata ccattcgcga gcctccggat gacgaccgta gtgatgaatc tctcctggcg
3541  ggaacagcaa aatatcaccc ggtcggcaaa caaattctcg tccctgattt ttcaccaccc
3601  cctgaccgcg aatggtgaga ttgagaatat aacctttcat tcccagcggt cggtcgataa
3661  aaaaatcgag ataaccgttg gcctcaatcg gcgttaaacc cgccaccaga tgggcattaa
3721  acgagtatcc cggcagcagg ggatcatttt gcgcttcagc catactttc atactcccac
3781  cattcagaga agaaaccaat tgtccatatt gcatcagaca ttgccgtcac tgcgtctttt
3841  actggctctt ctcgctaacc caaccggtaa ccccgcttat taaaagcatt ctgtaacaaa
3901  gcgggaccaa agccatgaca aaaacgcgta acaaaagtgt ctataatcac ggcagaaaag
3961  tccacattga ttatttgcac ggcgtcacac tttgctatgc catagcattt ttatccataa
4021  gattagcgga tcctacctga cgctttttat cgcaactctc tactgttttct ccatacccgt
4081  ttttttggac gcgtacaact caagtctgac ataaatgacc gctatgagca ctgcaattac
4141  acgccagatc gttctcGCTa ccGCAaccac cggtatgaac cagattggtg cgcactatga
4201  aggccacaag atcattgaga ttggtgccgt tgaagtggtg aaccgtcgcc tgacgggcaa
4261  taacttccat gtttatctca aacccgatcg gctggtggat ccggaagcct ttggcgtaca
4321  tggtattgcc gatgaatttt tgctcgataa gcccacgttt gccgaagtag ccgatgagtt
4381  catggactat attcgcggcg cggagttggt gatccataac gcagcgttcg atatcggctt
```

```
4441 tatggactac gagttttcgt tgcttaagcg cgatattccg aagaccaata ctttctgtaa 4501 ggtcaccgat agccttgcgg tggcgaggaa aatgtttccc ggtaagcgca acagcctcga 4561 tgcgttatgt gctcgctacg aaatagataa cagtaaacga acgctgcacg gggcattact 4621 cgatgcccag atccttgcgg aagtttatct ggcgatgacc ggtggtcaaa cgtcgatggc 4681 ttttgcgatg aaggagaga cacaacagca acaaggtgaa gcaacaattc agcgcattgt 4741 acgtcaggca agtaagttac gcgttgtttt tgcgacagat gaagagattg cagctcatga 4801 agcccgtctc gatctggtgc agaagaaagg cggaagttgc ctctggcgag cataatttaa 4861 tatcagtaaa ccggacataa cccatgaaga aaaatcgcgc ttttttgaag tgggcagggg 4921 gcaagtatcc cctgcttgat gatattaaac ggcatttgcc caagggcgaa tgtctggttg 4981 agccttttgt aggtgccggg tcggtgtttc tcaacaccga cttttctcgt tatatccttg 5041 ccgatatcaa tagcgacctg atcagtctct ataacattgt gaagatgcgt actgatgagt 5101 acgtacaggc cgcacgcgag ctgtttgttc ccgaaacaaa ttgcgccgag gtttactatc 5161 agttccgcga agagttcaac aaaagccagg atccgttccg tcgggcggta ctgttttat 5221 atttgaaccg ctacggttac aacggcctgt gtcgttacaa tctgcgcggt gagtttaacg 5281 tgccgttcgg ccgctacaaa aaaccctatt tcccggaagc agagttgtat cacttcgctg 5341 aaaaagcgca gaatgccttt ttctattgtg agtcttacgc cgatagcatg gcgcgcgcag 5401 atgatgcatc cgtcgtctat tgcgatccgc cttatgcacc gctgtctgcg accgccaact 5461 ttacggcgta tcacacaaac agttttacgc ttgaacaaca agcgcatctg gcggagatcg 5521 ccgaaggtct ggttgagcgc catattccag tgctgatctc caatcacgat acgatgttaa 5581 cgcgtgagtg gtatcagcgc gcaaaattgc atgtcgtcaa agttcgacgc agtataagca 5641 gcaacggcgg cacacgtaaa aaggtggacg aactgctggc tttgtacaaa ccaggagtcg 5701 tttcacccgc gaaaaaataa acttaattaa cggcactcct cagccaagtc aaaagcctcc 5761 gaccggaggc ttttgactac atgcccatgg cgtttacgcc ccgccctgcc actcatcgca 5821 gtactgttgt aattcattaa gcattctgcc gacatggaag ccatcacaaa cggcatgatg 5881 aacctgaatc gccagcggca tcagcacctt gtcgccttgc gtataatatt tgcccatagt 5941 gaaaacgggg gcgaagaagt tgtccatatt ggccacgttt aaatcaaaac tggtgaaact 6001 cacccaggga ttggctgaga cgaaaaacat attctcaata aacccttag ggaaataggc 6061 caggttttca ccgtaacacg ccacatcttg cgaatatatg tgtagaaact gccggaaatc 6121 gtcgtggtat tcactccaga gcgatgaaaa cgtttcagtt tgctcatgga aaacggtgta 6181 acaagggtga acactatccc atatcaccag ctcaccgtct tcattgccta tacggaactc 6241 cggatgagca ttcatcaggc gggcaagaat gtgaataaag gccggataaa acttgtgctt 6301 atttttcttt acggtcttta aaaaggccgt aatatccagc tgaacggtct ggttataggt 6361 acattgagca actgactgaa atgcctcaaa atgttcttta cgatgccatt gggatatatc 6421 aacggtggta tatccagtga ttttttctc catttagct tccttagctc ctgaaaatct 6481 cgataactca aaaaatacgc ccggtagtga tcttatttca ttatggtgaa agttggaacc 6541 tcttacgtgc caAgccaaat aggccgt
```

DP4

| | |
|---|---|
| LOCUS pJC184 | 6537 bp DNA circular |
| FEATURES | Location/Qualifiers |
| modified_base | 852..866 |
| | /note="USER junction" |
| terminator | 867..911 |
| | /note="rrnB1 transcriptional terminator" |
| modified_base | 919..933 |
| | /note="USER junction" |
| rep_origin | complement(39..777) |
| | /dnas_title="cloDF13" |
| | /vntifkey="33" |
| | /label=cloDF13 |
| terminator | complement(6319..6354) |
| | /note="P14/tonB bidirectional terminator" |
| | /note="termination of cat transcript is slightly weaker than in opposite direction" |
| modified_base | 6355..6367 |
| | /note="USER junction" |
| CDS | complement(6368..7027) |
| | /note="cat (CmR)" |
| | /note="from pACYCDuet-1" |
| modified_base | 6443..6443 |
| | /note="mutation" |
| | /note="annotated as a G in pACYCDuet cat marker annotation, here it is an A, but this mutation is silent from codon GTC (Val, 25% codon usage) to GTT (Val, 21% usage), so it should not be of functional relevance" |
| promoter | 7028..7125 |
| | /note="cat promoter" |
| | /note="from pACYCDuet-1" |
| modified_base | 7126..7141 |
| | /note="USER junction" |
| CDS | complement(2885..3763) |
| | /dnas_title="araC" |
| | /vntifkey="4" |
| | /label=araC |
| misc_feature | 2936..2936 |
| | /note="originally an 'a' in annotation" |
| misc_feature | 2975..2975 |
| | /note="originally a t in annotation" |
| misc_feature | 3041..3041 |
| | /note="originally an a in annotation" |
| misc_feature | 3245..3245 |
| | /note="originally a c in annotation" |
| misc_feature | 3410..3410 |
| | /note="originally an a in annotation" |
| misc_feature | 3569..3569 |
| | /note="originally a g in annotation" |
| misc_feature | 3716..3716 |
| | /note="originally a g in annotation" |
| CDS | complement(934..2208) |
| | /dnas_title="III" |
| | /vntifkey="4" |
| | /label=III |
| misc_feature | complement(1021..1066) |
| | /note="modified to remove internal promoter" |
| misc_feature | 2423..2435 |
| | /note="USER linker" |
| RBS | complement(2209..2222) |
| | /note="sd8 RBS (from Ringquist and Gold Mol. Micro. 1992)" |
| modified_base | complement(2223..2237) |
| | /note="USER junction" |
| terminator | complement(2443..2867) |
| | /note="rrnB1 transcriptional terminator" |
| misc_feature | 2868..2884 |
| | /note="USER linker" |
| modified_base | 789..806 |
| | /note="User Junction" |
| misc_difference | 912..918 |
| | /note="cloning scar" |
| protein_bind | complement(2408..2422) |
| | /note="UAS II" |
| protein_bind | complement(2386..2404) |
| | /note="UAS I" |
| prim_transcript | complement(2297..2297) |
| | /note="Transcription Start Site" |
| enhancer | complement(2375..2422) |
| | /note="Protected by pspF" |
| RBS | complement(2406..2415) |
| | /note="pspF RBS" |
| promoter | 2356..2384 |
| | /note="pspF P1" |
| promoter | 2375..2402 |
| | /note="pspF P2" |
| promoter | 2242..2269 |
| | /note="pspF P3" |
| −35_signal | 2242..2247 |
| | /note="−35" |
| −10_signal | 2264..2269 |
| | /note="−10" |
| −35_signal | 2356..2361 |
| | /note="−35" |
| −35_signal | 2375..2380 |
| | /note="−35" |
| −10_signal | 2379..2384 |
| | /note="−10" |
| −10_signal | 2397..2402 |
| | /note="−10" |
| prim_transcript | 2276..2276 |
| | /note="" |
| prim_transcript | 2390..2390 |
| | /note="" |
| prim_transcript | 2406..2406 |
| | /note="" |
| promoter | complement(2308..2324) |
| | /note="Sigma54 Core Promoter" |
| −35_signal | complement(2321..2322) |
| | /note="−24" |
| −10_signal | complement(2309..2310) |
| | /note="−12" |
| protein_bind | complement(2326..2358) |
| | /note="High Affinity IHF Site" |
| protein_bind | complement(2278..2296) |
| | /note="tetR binding site" |
| misc_feature | 3861..3861 |
| | /dnas_title="C to A ***" |
| | /vntifkey="21" |
| | /label=C to A *** |
| misc_feature | 3779..3779 |
| | /dnas_title="A to G ***" |
| | /vntifkey="21" |
| | /label=A to G *** |
| prim_transcript | complement(3927..3927) |
| | /note="pC TSS" |
| protein_bind | 3950..3966 |
| | /note="araO1" |
| protein_bind | 3929..3945 |
| | /note="araO1" |
| protein_bind | 3792..3808 |
| | /note="araO2" |
| protein_bind | 3971..3992 |
| | /note="CAP" |
| misc_feature | 4051..4051 |
| | /note="" |
| misc_feature | 4037..4037 |
| | /note="" |
| prim_transcript | 4075..4075 |
| | /note="pBAD TSS" |
| protein_bind | 4003..4019 |
| | /note="araI1" |
| protein_bind | 4024..4040 |
| | /note="araI2" |
| −10_signal | 4061..4066 |
| | /note="−10" |
| −35_signal | 4037..4042 |
| | /note="−35" |
| promoter | 3971..4100 |
| | /dnas_title="pBAD" |
| | /vntifkey="30" |
| | /label=pBAD |

DP4

| LOCUS pJC184 | 6537 bp DNA circular |
|---|---|
| FEATURES | Location/Qualifiers |
| RBS | 4104..4123 |
| | /note="Native dnaQ RBS" |
| CDS | 4124..4855 |
| | /dnas_title="dnaQ926" |
| | /vntifkey="4" |
| | /label=dnaQ926 |
| conflict | 4157..4159 |
| | /note="D12A" |
| conflict | 4163..4165 |
| | /note="E14A" |
| RBS | 4865..4883 |
| | /note="Modified mutS RBS" |

DP4

| LOCUS pJC184 | 6537 bp DNA circular |
|---|---|
| FEATURES | Location/Qualifiers |
| modified_base | 4865..4878 |
| | /note="USER Junction" |
| CDS | 4884..5720 |
| | /note="dam (wt)" |
| CDS | 5749..6294 |
| | /note="seqA (wt)" |
| RBS | 5729..5748 |
| | /note="seqA Native RBS" |
| modified_base | 6295..6311 |
| | /note="USER junction" |
| source | 1..7141 |

(SEQ ID NO: 33)

```
   1 cactcggtcg ctacgctccg ggcgtgagac tgcggcgggc gctgcggaca catacaaagt
  61 tacccacaga ttccgtggat aagcagggga ctaacatgtg aggcaaaaca gcagggccgc
 121 gccggtggcg tttttccata ggctccgccc tcctgccaga gttcacataa acagacgctt
 181 ttccggtgca tctgtgggag ccgtgaggct caaccatgaa tctgacagta cgggcgaaac
 241 ccgacaggac ttaaagatcc ccaccgtttc cggcgggtcg ctccctcttg cgctctcctg
 301 ttccgaccct gccgtttacc ggatacctgt tccgcctttc tcccttacgg gaagtgtggc
 361 gctttctcat agctcacaca ctggtatctc ggctcggtgt aggtcgttcg ctccaagctg
 421 ggctgtaagc aagaactccc cgttcagccc gactgctgcg ccttatccgg taactgttca
 481 cttgagtcca acccggaaaa gcacggtaaa acgccactgg cagcagccat tggtaactgg
 541 gagttcgcag aggatttgtt tagctaaaca cgcggttgct cttgaagtgt gcgccaaagt
 601 ccggctacac tggaaggaca gatttggttg ctgtgctctg cgaaagccag ttaccacggt
 661 taagcagttc cccaactgac ttaaccttcg atcaaaccac ctccccaggt ggttttttcg
 721 tttacagggc aaaagattac gcgcagaaaa aaaggatctc aagaagatcc tttgatcttt
 781 tctactgaac cgctctagat ttcagtgcaa tttatctctt caaatgtagc acctgaagtc
 841 agccccaggag gaagaggaca tccggtcaaa taaaacgaaa ggctcagtcg aaagactggg
 901 cctttcgttt tGCTGAGGag acttagggac cctttaagac tccttattac gcagtatgtt
 961 agcaaacgta gaaaatacat acataaaggt ggcaacatat aaaagaaacg caaagacacc
1021 gcggaacagg ttgatcttat cgcagtcgat actgaactcg taaggtttac cagcgccaaa
1081 gacaaagggc gacattcaa ccgattgagg gagggaaggt aaatattgac ggaaattatt
1141 cattaaaggt gaattatcac cgtcaccgac ttgagccatt tgggaattag agccagcaaa
1201 atcaccagta gcaccattac cattagcaag gccggaaacg tcaccaatga aaccatcgat
1261 agcagcaccg taatcagtag cgacagaatc aagtttgcct ttagcgtcag actgtagcgc
1321 gttttcatcg gcatttttcgg tcatagcccc cttattagcg tttgccatct tttcataatc
1381 aaaatcaccg gaaccagagc caccaccgga accgcctccc tcagagccgc caccctcaga
1441 accgccaccc tcagagccac caccctcaga gccgccacca gaaccaccac cagagccgcc
1501 gccagcattg acaggaggtt gaggcaggtc agacgattgg ccttgatatt cacaaacgaa
1561 tgatcctca ttaaagccag aatggaaagc gcagtctctg aatttaccgt tccagtaagc
1621 gtcatacatg gcttttgatg atacaggagt gtactggtaa taagttttaa cggggtcagt
1681 gccttgagta acagtgcccg tataaacagt taatgccccc tgcctatttc ggaacctatt
```

```
1741 attctgaaac atgaaagtat taagaggctg agactcctca agagaaggat taggattagc 1801 ggggttttgc tcagtaccag gcggataagt gccgtcgaga gggttgatat aagtatagcc 1861 Aggaataggt gtatcaccgt actcaggagg tttagtaccg ccaccctcag aaccgccacc 1921 ctcagaaccg ccaccctcag agccaccacc ctcattttca gggatagcaa gcccaatagg 1981 aacccatgta ccgtaacact gagtttcgtc accagtacaa actacaacgc ctgtagcatt 2041 ccacagacag ccctcatagt tagcgtaacg atctaaagtt ttgtcgtctt tccagacgtt 2101 agtaaatgaa ttttctgtat ggggttttgc taaacaactt tcaacagttt cagcggagtg 2161 agaatagaaa ggaacaacta aaggaattgc gaataataat tttttcattt tttttttcct 2221 ttactgcacc tgcaggtaat gttgtcctct tgatttctgc gttcaggatt gtcctgctct 2281 ctatcactga tagggatgaa ctgttaatac aatttgcgtg ccaattttt atctttttga 2341 tttataaaga tctgattgaa gaatcaacag caacatgcca ggatgagtta gcgaattaca 2401 ctaacaagtg gcgaatttca tcacggagcc aatgtcctca gcgagtttgt agaaacgcaa 2461 aaaggccatc cgtcaggatg gccttctgct taatttgatg cctggcagtt tatggcgggc 2521 gtcctgcccg ccaccctccg ggccgttgct tcgcaacgtt caaatccgct cccggcggat 2581 ttgtcctact caggagagcg ttcaccgaca acaacagat aaaacgaaag gcccagtctt 2641 tcgactgagc ctttcgtttt atttgatgcc tggcagttcc ctactctcgc atggggagac 2701 cccacactac catcggcgct acggcgtttc acttctgagt tcggcatggg gtcaggtggg 2761 accaccgcgc tactgccgcc aggcaaattc tgttttatca gaccgcttct gcgttctgat 2821 ttaatctgta tcaggctgaa aatcttctct catccgccaa acagccagg ccctactga 2881 ctgtttatga caacttgacg gctacatcat tcacttttc ttcacaaccg gcacggaact 2941 cgctcgggct ggccccggtg cattttttaa ataccgcga gaaatagagt tgatcgtcaa 3001 aaccaacatt gcgaccgacg gtggcgatag gcatccgggt ggtgctcaaa agcagcttcg 3061 cctggctgat acgttggtcc tcgcgccagc ttaagacgct aatccctaac tgctggcgga 3121 aaagatgtga cagacgcgac ggcgacaagc aaacatgctg tgcgacgctg gcgatatcaa 3181 aattgctgtc tgccaggtga tcgctgatgt actgacaagc ctcgcgtacc cgattatcca 3241 tcggtggatg gagcgactcg ttaatcgctt ccatgcgccg cagtaacaat tgctcaagca 3301 gatttatcgc cagcagctcc gaatagcgcc cttccccttg cccggcgtta atgatttgcc 3361 caaacaggtc gctgaaatgc ggctggtgcg cttcatccgg gcgaaagaac ccgtattgg 3421 caaatattga cggccagtta agccattcat gccagtaggc gcgcggacga aagtaaaccc 3481 actggtgata ccattcgcga gcctccggat gacgaccgta gtgatgaatc tctcctggcg 3541 ggaacagcaa atatcaccc ggtcggcaaa caattctcg tccctgattt ttcaccaccc 3601 cctgaccgcg aatggtgaga ttgagaatat aacctttcat tcccagcggt cggtcgataa 3661 aaaaatcgag ataaccgttg gcctcaatcg gcgttaaacc cgccaccaga tgggcattaa 3721 acgagtatcc cggcagcagg ggatcatttt gcgcttcagc catactttc atactcccac 3781 cattcagaga agaaaccaat tgtccatatt gcatcagaca ttgccgtcac tgcgtctttt 3841 actggctctt ctcgctaacc caaccggtaa ccccgcttat taaaagcatt ctgtaacaaa 3901 gcgggaccaa agccatgaca aaaacgcgta acaaaagtgt ctataatcac ggcagaaaag 3961 tccacattga ttatttgcac ggcgtcacac tttgctatgc catagcattt ttatccataa 4021 gattagcgga tcctacctga cgctttttat cgcaactctc tactgtttct ccatacccgt 4081 ttttttggac gcgtacaact caagtctgac ataaatgacc gctatgagca ctgcaattac 4141 acgccagatc gttctcGCTa ccGCAaccac cggtatgaac cagattggtg cgcactatga
```

-continued

```
4201  aggccacaag atcattgaga ttggtgccgt tgaagtggtg aaccgtcgcc tgacgggcaa
4261  taacttccat gtttatctca aacccgatcg gctggtggat ccggaagcct ttggcgtaca
4321  tggtattgcc gatgaatttt tgctcgataa gcccacgttt gccgaagtag ccgatgagtt
4381  catggactat attcgcggcg cggagttggt gatccataac gcagcgttcg atatcggctt
4441  tatggactac gagttttcgt tgcttaagcg cgatattccg aagaccaata ctttctgtaa
4501  ggtcaccgat agccttgcgg tggcgaggaa aatgtttccc ggtaagcgca acagcctcga
4561  tgcgttatgt gctcgctacg aaatagataa cagtaaacga acgctgcacg gggcattact
4621  cgatgcccag atccttgcgg aagtttatct ggcgatgacc ggtggtcaaa cgtcgatggc
4681  ttttgcgatg gaaggagaga cacaacagca acaaggtgaa gcaacaattc agcgcattgt
4741  acgtcaggca agtaagttac gcgttgtttt tgcgacagat gaagagattg cagctcatga
4801  agcccgtctc gatctggtgc agaagaaagg cggaagttgc ctctggcgag cataatttaa
4861  tatcagtaaa ccggacataa cccatgaaga aaaatcgcgc ttttttgaag tgggcagggg
4921  gcaagtatcc cctgcttgat gatattaaac ggcatttgcc caagggcgaa tgtctggttg
4981  agccttttgt aggtgccggg tcggtgtttc tcaacaccga cttttctcgt tatatccttg
5041  ccgatatcaa tagcgacctg atcagtctct ataacattgt gaagatgcgt actgatgagt
5101  acgtacaggc cgcacgcgag ctgtttgttc ccgaaacaaa ttgcgccgag gtttactatc
5161  agttccgcga agagttcaac aaaagccagg atccgttccg tcgggcggta ctgtttttat
5221  atttgaaccg ctacggttac aacggcctgt gtcgttacaa tctgcgcggt gagtttaacg
5281  tgccgttcgg ccgctacaaa aaaccctatt tcccggaagc agagttgtat cacttcgctg
5341  aaaaagcgca gaatgccttt ttctattgtg agtcttacgc cgatagcatg gcgcgcgcag
5401  atgatgcatc cgtcgtctat tgcgatccgc cttatgcacc gctgtctgcg accgccaact
5461  ttacggcgta tcacacaaac agttttacgc ttgaacaaca agcgcatctg gcggagatcg
5521  ccgaaggtct ggttgagcgc catattccag tgctgatctc caatcacgat acgatgttaa
5581  cgcgtgagtg gtatcagcgc gcaaaattgc atgtcgtcaa agttcgacgc agtataagca
5641  gcaacggcgg cacacgtaaa aaggtggacg aactgctggc tttgtacaaa ccaggagtcg
5701  tttcacccgc gaaaaaataa ttcagctaag acactgcact ggattaagat gaaaacgatt
5761  gaagttgatg atgaactcta cagctatatt gccagccaca ctaagcatat cggcgagagc
5821  gcatccgaca tttttacggcg tatgttgaaa ttttccgccg catcacagcc tgctgctccg
5881  gtgacgaaag aggttcgcgt tgcgtcacct gctatcgtcg aagcgaagcc ggtcaaaacg
5941  attaaagaca aggttcgcgc aatgcgtgaa cttctgcttt cggatgaata cgcagagcaa
6001  aagcgagcgg tcaatcgctt tatgctgctg ttgtctacac tatattctct tgacgcccag
6061  gcgtttgccg aagcaacgga atcgttgcac ggtcgtacac gcgtttactt tgcggcagat
6121  gaacaaacgc tgctgaaaaa tggtaatcag accaagccga acatgtgcc aggcacgccg
6181  tattgggtga tcaccaacac caacaccggc cgtaaatgca gcatgatcga acacatcatg
6241  cagtcgatgc aattcccggc ggaattgatt gagaaggttt gcggaactat ctaaacttaa
6301  ttaacggcac tcctcagcca agtcaaaagc ctccgaccgg aggcttttga ctacatgccc
6361  atggcgttta cgccccgccc tgccactcat cgcagtactg ttgtaattca ttaagcattc
6421  tgccgacatg gaagccatca caaacggcat gatgaacctg aatcgccagc ggcatcagca
6481  ccttgtcgcc ttgcgtataa tatttgccca tagtgaaaac gggggcgaag aagttgtcca
6541  tattggccac gtttaaatca aaactggtga aactcaccca gggattggct gagacgaaaa
```

-continued

```
6601 acatattctc aataaaccct ttagggaaat aggccaggtt ttcaccgtaa cacgccacat 6661 cttgcgaata tatgtgtaga aactgccgga aatcgtcgtg gtattcactc cagagcgatg 6721 aaaacgtttc agtttgctca tggaaaacgg tgtaacaagg gtgaacacta tcccatatca 6781 ccagctcacc gtctttcatt gccatacgga actccggatg agcattcatc aggcgggcaa 6841 gaatgtgaat aaaggccgga taaaacttgt gcttattttt ctttacggtc tttaaaaagg 6901 ccgtaatatc cagctgaacg gtctggttat aggtacattg agcaactgac tgaaatgcct 6961 caaaatgttc tttacgatgc cattgggata tatcaacggt ggtatatcca gtgatttttt 7021 tctccatttt agcttcctta gctcctgaaa atctcgataa ctcaaaaaat acgcccggta 7081 gtgatcttat ttcattatgg tgaaagttgg aacctcttac gtgccaAgcc aaataggccg 7141 t
```

DP5

LOCUS pJC184 6537 bp DNA circular
FEATURES Location/Qualifiers

| | |
|---|---|
| modified_base | 852..866 /note="USER junction" |
| terminator | 867..911 /note="rrnB1 transcriptional terminator" |
| modified_base | 919..933 /note="USER junction" |
| rep_origin | complement(39..777) /dnas_title="cloDF13" /vntifkey="33" /label=cloDF13 |
| terminator | complement(7258..7293) /note="P14/tonB bidirectional terminator" /note="termination of cat transcript is slightly weaker than in opposite direction" |
| modified_base | 7294..7306 /note="USER junction" |
| CDS | complement(7307..7966) /note="cat (CmR)" /note="from pACYCDuet-1" |
| modified_base | 7382..7382 /note="mutation" /note="annotated as a G in pACYCDuet cat marker annotation, here it is an A, but this mutation is silent from codon GTC (Val, 25% codon usage) to GTT (Val, 21% usage), so it should not be of functional relevance" |
| promoter | 7967..8064 /note="cat promoter" /note="from pACYCDuet-1" |
| modified_base | 8065..8080 /note="USER junction" |
| CDS | complement(2885..3763) /dnas_title="araC" /vntifkey="4" /label=araC |
| misc_feature | 2936..2936 /note="originally an 'a' in annotation" |
| misc_feature | 2975..2975 /note="originally a t in annotation" |
| misc_feature | 3041..3041 /note="originally an a in annotation" |
| misc_feature | 3245..3245 /note="originally a c in annotation" |
| misc_feature | 3410..3410 /note="originally an a in annotation" |
| misc_feature | 3569..3569 /note="originally a g in annotation" |
| misc_feature | 3716..3716 /note="originally a g in annotation" |
| CDS | complement(934..2208) /dnas_title="III" /vntifkey="4" /label=III |

-continued

DP5

LOCUS pJC184 6537 bp DNA circular
FEATURES Location/Qualifiers

| | |
|---|---|
| misc_feature | complement(1021..1066) /note="modified to remove internal promoter" |
| misc_feature | 2423..2435 /note="USER linker" |
| RBS | complement(2209..2222) /note="sd8 RBS (from Ringquist and Gold Mol. Micro. 1992)" |
| modified_base | complement(2223..2237) /note="USER junction" |
| terminator | complement(2443..2867) /note="rrnB1 transcriptional terminator" |
| misc_feature | 2868..2884 /note="USER linker" |
| modified_base | 789..806 /note="User Junction" |
| misc_difference | 912..918 /note="cloning scar" |
| protein_bind | complement(2408..2422) /note="UAS II" |
| protein_bind | complement(2386..2404) /note="UAS I" |
| prim_transcript | complement(2297..2297) /note="Transcription Start Site" |
| enhancer | complement(2375..2422) /note="Protected by pspF" |
| RBS | complement(2406..2415) /note="pspF RBS" |
| promoter | 2356..2384 /note="pspF P1" |
| promoter | 2375..2402 /note="pspF P2" |
| promoter | 2242..2269 /note="pspF P3" |
| −35_signal | 2242..2247 /note="−35" |
| −10_signal | 2264..2269 /note="−10" |
| −35_signal | 2356..2361 /note="−35" |
| −35_signal | 2375..2380 /note="−35" |
| −10_signal | 2379..2384 /note="−10" |
| −10_signal | 2397..2402 /note="−10" |
| prim_transcript | 2276..2276 /note="" |
| prim_transcript | 2390..2390 /note="" |
| prim_transcript | 2406..2406 /note="" |

DP5

LOCUS  pJC184  6537 bp  DNA  circular
FEATURES      Location/Qualifiers

| | |
|---|---|
| promoter | complement(2308..2324) |
| | /note="Sigma54 Core Promoter" |
| −35_signal | complement(2321..2322) |
| | /note="−24" |
| −10_signal | complement(2309..2310) |
| | /note="−12" |
| protein_bind | complement(2326..2358) |
| | /note="High Affinity IHF Site" |
| protein_bind | complement(2278..2296) |
| | /note="tetR binding site" |
| misc_feature | 3861..3861 |
| | /dnas_title="C to A ***" |
| | /vntifkey="21" |
| | /label=C to A *** |
| misc_feature | 3779..3779 |
| | /dnas_title="A to G ***" |
| | /vntifkey="21" |
| | /label=A to G *** |
| prim_transcript | complement(3927..3927) |
| | /note="pC TSS" |
| protein_bind | 3950..3966 |
| | /note="araO1" |
| protein_bind | 3929..3945 |
| | /note="araO1" |
| protein_bind | 3792..3808 |
| | /note="araO2" |
| protein_bind | 3971..3992 |
| | /note="CAP" |
| misc_feature | 4051..4051 |
| | /note="" |
| misc_feature | 4037..4037 |
| | /note="" |
| prim_transcript | 4075..4075 |
| | /note="pBAD TSS" |
| protein_bind | 4003..4019 |
| | /note="araI1" |
| protein_bind | 4024..4040 |
| | /note="araI2" |
| −10_signal | 4061..4066 |
| | /note="−10" |
| −35_signal | 4037..4042 |
| | /note="−35" |

DP5

LOCUS  pJC184  6537 bp  DNA  circular
FEATURES      Location/Qualifiers

| | |
|---|---|
| promoter | 3971..4100 |
| | /dnas_title="pBAD" |
| | /vntifkey="30" |
| | /label=pBAD |
| RBS | 4104..4123 |
| | /note="Native dnaQ RBS" |
| CDS | 4124..4855 |
| | /dnas_title="dnaQ926" |
| | /vntifkey="4" |
| | /label=dnaQ926 |
| conflict | 4157..4159 |
| | /note="D12A" |
| conflict | 4163..4165 |
| | /note="E14A" |
| RBS | 4865..4883 |
| | /note="Modified mutS RBS" |
| modified_base | 4865..4878 |
| | /note="USER Junction" |
| CDS | 4884..5720 |
| | /note="dam (wt)" |
| CDS | 5749..6294 |
| | /note="seqA (wt)" |
| RBS | 5729..5748 |
| | /note="seqA Native RBS" |
| modified_base | 6275..6292 |
| | /note="USER Junction" |
| CDS | 6323..6577 |
| | /note="PBS2 UGI" |
| RBS | 6302..6322 |
| | /note="Native UGI RBS" |
| modified_base | 6299..6318 |
| | /note="USER Junction" |
| RBS | 6586..6606 |
| | /note="dnaE RBS" |
| modified_base | 6582..6600 |
| | /note="USER Junction" |
| CDS | 6607..7233 |
| | /note="pmCDA1 (opt)" |
| modified_base | 7234..7250 |
| | /note="USER junction" |
| source | 1..8080 |

(SEQ ID NO: 34)

```
  1 cactcggtcg ctacgctccg ggcgtgagac tgcggcgggc gctgcggaca catacaaagt
 61 tacccacaga ttccgtggat aagcagggga ctaacatgtg aggcaaaaca gcagggccgc
121 gccggtggcg ttttttccata ggctccgccc tcctgccaga gttcacataa acagacgctt
181 ttccggtgca tctgtgggag ccgtgaggct caaccatgaa tctgacagta cgggcgaaac
241 ccgacaggac ttaaagatcc ccaccgtttc cggcgggtcg ctccctcttg cgctctcctg
301 ttccgaccct gccgttacc ggatacctgt tccgcctttc tcccttacgg gaagtgtggc
361 gctttctcat agctcacaca ctggtatctc ggctcggtgt aggtcgttcg ctccaagctg
421 ggctgtaagc aagaactccc cgttcagccc gactgctgcg ccttatccgg taactgttca
481 cttgagtcca acccggaaaa gcacggtaaa acgccactgg cagcagccat tggtaactgg
541 gagttcgcag aggatttgtt tagctaaaca cgcggttgct cttgaagtgt gcgccaaagt
601 ccggctacac tggaaggaca gatttggttg ctgtgctctg cgaaagccag ttaccacggt
661 taagcagttc cccaactgac ttaaccttcg atcaaaccac ctccccaggt ggttttttcg
721 tttacagggc aaaagattac gcgcagaaaa aaaggatctc aagaagatcc tttgatcttt
781 tctactgaac cgctctagat ttcagtgcaa tttatctctt caaatgtagc acctgaagtc
```

-continued

```
 841 agcccaggag gaagaggaca tccggtcaaa taaaacgaaa ggctcagtcg aaagactggg 901 cctttcgttt tGCTGAGGag acttagggac cctttaagac tccttattac gcagtatgtt 961 agcaaacgta gaaaatacat acataaaggt ggcaacatat aaaagaaacg caaagacacc 1021 gcggaacagg ttgatcttat cgcagtcgat actgaactcg taaggtttac cagcgccaaa 1081 gacaaaaggg cgacattcaa ccgattgagg gagggaaggt aaatattgac ggaaattatt 1141 cattaaaggt gaattatcac cgtcaccgac ttgagccatt tgggaattag agccagcaaa 1201 atcaccagta gcaccattac cattagcaag gccggaaacg tcaccaatga aaccatcgat 1261 agcagcaccg taatcagtag cgacagaatc aagtttgcct ttagcgtcag actgtagcgc 1321 gttttcatcg gcattttcgg tcatagcccc cttattagcg tttgccatct tttcataatc 1381 aaaatcaccg gaaccagagc caccaccgga accgcctccc tcagagccgc caccctcaga 1441 accgccaccc tcagagccac caccctcaga gccgccacca gaaccaccac cagagccgcc 1501 gccagcattg acaggaggtt gaggcaggtc agacgattgg ccttgatatt cacaaacgaa 1561 tggatcctca ttaaagccag aatggaaagc gcagtctctg aatttaccgt tccagtaagc 1621 gtcatacatg gcttttgatg atacaggagt gtactggtaa taagttttaa cggggtcagt 1681 gccttgagta acagtgcccg tataaacagt taatgccccc tgcctatttc ggaacctatt 1741 attctgaaac atgaaagtat taagaggctg agactcctca agagaaggat taggattagc 1801 ggggttttgc tcagtaccag gcggataagt gccgtcgaga gggttgatat aagtatagcc 1861 cggaataggt gtatcaccgt actcaggagg tttagtaccg ccaccctcag aaccgccacc 1921 ctcagaaccg ccaccctcag agccaccacc ctcattttca gggatagcaa gcccaatagg 1981 aacccatgta ccgtaacact gagtttcgtc accagtacaa actacaacgc ctgtagcatt 2041 ccacagacag ccctcatagt tagcgtaacg atctaaagtt ttgtcgtctt tccagacgtt 2101 agtaaatgaa ttttctgtat ggggttttgc taaacaactt tcaacagttt cagcggagtg 2161 agaatagaaa ggaacaacta aaggaattgc gaataataat tttttcattt ttttttttcct 2221 ttactgcacc tgcaggtaat gttgtcctct tgatttctgc gttcaggatt gtcctgctct 2281 ctatcactga tagggatgaa ctgttaatac aatttgcgtg ccaattttt atctttttga 2341 tttataaaga tctgattgaa gaatcaacag caacatgcca ggatgagtta gcgaattaca 2401 ctaacaagtg gcgaatttca tcacggagcc aatgtcctca gcgagtttgt agaaacgcaa 2461 aaaggccatc cgtcaggatg gccttctgct taatttgatg cctggcagtt tatggcgggc 2521 gtcctgcccg ccaccctccg ggccgttgct tcgcaacgtt caaatccgct cccggcggat 2581 ttgtcctact caggagagcg ttcaccgaca aacaacagat aaaacgaaag gcccagtctt 2641 tcgactgagc ctttcgtttt atttgatgcc tggcagttcc ctactctcgc atgggagac 2701 cccacactac catcggcgct acggcgtttc acttctgagt tcggcatggg gtcaggtggg 2761 accaccgcgc tactgccgcc aggcaaattc tgttttatca gaccgcttct gcgttctgat 2821 ttaatctgta tcaggctgaa aatcttctct catccgccaa aacagccagg gccctactga 2881 ctgtttatga caacttgacg gctacatcat tcactttttc ttcacaaccg cacggaact 2941 cgctcgggct ggccccggtg cattttttaa atacccgcga gaaatagagt tgatcgtcaa 3001 aaccaacatt gcgaccgacg gtggcgatag gcatccgggt ggtgctcaaa agcagcttcg 3061 cctggctgat acgttggtcc tcgcgccagc ttaagacgct aatccctaac tgctggcgga 3121 aaagatgtga cagacgcgac ggcgacaagc aaacatgctg tgcgacgctg gcgatatcaa 3181 aattgctgtc tgccaggtga tcgctgatgt actgacaagc ctcgcgtacc cgattatcca 3241 tcggtggatg gagcgactcg ttaatcgctt ccatgcgccg cagtaacaat tgctcaagca
```

-continued

```
3301 gatttatcgc cagcagctcc gaatagcgcc cttccccttg cccggcgtta atgatttgcc
3361 caaacaggtc gctgaaatgc ggctggtgcg cttcatccgg gcgaaagaac cccgtattgg
3421 caaatattga cggccagtta agccattcat gccagtaggc gcgcggacga aagtaaaccc
3481 actggtgata ccattcgcga gcctccggat gacgaccgta gtgatgaatc tctcctggcg
3541 ggaacagcaa atatcaccc ggtcggcaaa caaattctcg tccctgattt ttcaccaccc
3601 cctgaccgcg aatggtgaga ttgagaatat aacctttcat tcccagcggt cggtcgataa
3661 aaaaatcgag ataaccgttg gcctcaatcg gcgttaaacc cgccaccaga tgggcattaa
3721 acgagtatcc cggcagcagg ggatcatttt gcgcttcagc catacttttc atactcccac
3781 cattcagaga agaaaccaat tgtccatatt gcatcagaca ttgccgtcac tgcgtctttt
3841 actggctctt ctcgctaacc caaccggtaa ccccgcttat taaaagcatt ctgtaacaaa
3901 gcgggaccaa agccatgaca aaaacgcgta acaaaagtgt ctataatcac ggcagaaaag
3961 tccacattga ttatttgcac ggcgtcacac tttgctatgc catagcattt ttatccataa
4021 gattagcgga tcctacctga cgcttttat cgcaactctc tactgtttct ccatacccgt
4081 ttttttggac gcgtacaact caagtctgac ataaatgacc gctatgagca ctgcaattac
4141 acgccagatc gttctcGCTa ccGCAaccac cggtatgaac cagattggtg cgcactatga
4201 aggccacaag atcattgaga ttggtgccgt tgaagtggtg aaccgtcgcc tgacgggcaa
4261 taacttccat gtttatctca aacccgatcg gctggtggat ccggaagcct ttggcgtaca
4321 tggtattgcc gatgaatttt tgctcgataa gcccacgttt gccgaagtag ccgatgagtt
4381 catggactat attcgcggcg cggagttggt gatccataac gcagcgttcg atatcggctt
4441 tatggactac gagttttcgt tgcttaagcg cgatattccg aagaccaata cttctctgtaa
4501 ggtcaccgat agccttgcgg tggcgaggaa aatgtttccc ggtaagcgca acagcctcga
4561 tgcgttatgt gctcgctacg aaatagataa cagtaaacga acgctgcacg gggcattact
4621 cgatgcccag atccttgcgg aagtttatct ggcgatgacc ggtggtcaaa cgtcgatggc
4681 ttttgcgatg gaaggagaga cacaacagca acaaggtgaa gcaacaattc agcgcattgt
4741 acgtcaggca agtaagttac gcgttgtttt tgcgacagat gaagagattg cagctcatga
4801 agcccgtctc gatctggtgc agaagaaagg cggaagttgc ctctggcgag cataatttaa
4861 tatcagtaaa ccggacataa cccatgaaga aaaatcgcgc tttttgaag tgggcagggg
4921 gcaagtatcc cctgcttgat gatattaaac ggcatttgcc caagggcgaa tgtctggttg
4981 agccttttgt aggtgccggg tcggtgtttc tcaacaccga cttttctcgt tatatccttg
5041 ccgatatcaa tagcgacctg atcagtctct ataacattgt gaagatgcgt actgatgagt
5101 acgtacaggc cgcacgcgag ctgtttgttc ccgaaacaaa ttgcgccgag gtttactatc
5161 agttccgcga agagttcaac aaaaagccagg atccgttccg tcgggcggta ctgtttttat
5221 atttgaaccg ctacggttac aacggcctgt gtcgttacaa tctgcgcggt gagtttaacg
5281 tgccgttcgg ccgctacaaa aaaccctatt tcccggaagc agagttgtat cacttcgctg
5341 aaaaagcgca gaatgccttt ttctattgtg agtcttacgc cgatagcatg gcgcgcgcag
5401 atgatgcatc cgtcgtctat tgcgatccgc cttatgcacc gctgtctgcg accgccaact
5461 ttacggcgta tcacacaaac agttttacgc ttgaacaaca agcgcatctg gcggagatcg
5521 ccgaaggtct ggttgagcgc catattccag tgctgatctc caatcacgat acgatgttaa
5581 cgcgtgagtg gtatcagcgc gcaaaattgc atgtcgtcaa agttcgacgc agtataagca
5641 gcaacggcgg cacacgtaaa aaggtggacg aactgctggc tttgtacaaa ccaggagtcg
```

-continued

```
5701 tttcacccgc gaaaaaataa ttcagctaag acactgcact ggattaagat gaaaacgatt
5761 gaagttgatg atgaactcta cagctatatt gccagccaca ctaagcatat cggcgagagc
5821 gcatccgaca ttttacggcg tatgttgaaa ttttccgccg catcacagcc tgctgctccg
5881 gtgacgaaag aggttcgcgt tgcgtcacct gctatcgtcg aagcgaagcc ggtcaaaacg
5941 attaaagaca aggttcgcgc aatgcgtgaa cttctgcttt cggatgaata cgcagagcaa
6001 aagcgagcgg tcaatcgctt tatgctgctg ttgtctacac tatattctct tgacgcccag
6061 gcgtttgccg aagcaacgga atcgttgcac ggtcgtacac gcgtttactt tgcggcagat
6121 gaacaaacgc tgctgaaaaa tggtaatcag accaagccga acatgtgcc aggcacgccg
6181 tattgggtga tcaccaacac caacaccggc cgtaaatgca gcatgatcga acacatcatg
6241 cagtcgatgc aattcccggc ggaattgatt gagaaggttt gcggaactat ctaataatac
6301 aaaaattagg aggaatttca acatgacaaa tttatctgac atcattgaaa agaaacagg
6361 aaaacaacta gtgattcaag aatcaattct aatgttacca gaagaagtag aggaagtaat
6421 tgggaataaa ccagaaagtg atattttagt tcatactgct tatgatgaaa gtacagatga
6481 aaatgtaatg ctattaactt cagatgctcc agaatataaa ccttgggctt tagtaattca
6541 agacagtaat ggagaaaata aaattaaaat gttataagtc gagattaagt aaaccggaat
6601 ctgaagatga ccgacgcgga atacgttcgt atccacgaaa aactggacat ctacaccttc
6661 aaaaaacagt tcttcaacaa caaaaaatct gtttctcacc gttgctacgt tctgttcgaa
6721 ctgaaacgtc gtggtgaacg tcgtgcgtgc ttctggggtt acgcggttaa caaaccgcag
6781 tctggtaccg aacgtggtat ccacgcggaa atcttctcta tccgtaaagt tgaagaatac
6841 ctgcgtgaca acccgggtca gttcaccatc aactggtact cttcttggtc tccgtgcgcg
6901 gactgcgcgg aaaaaatcct ggaatggtac aaccaggaac tgcgtggtaa cggtcacacc
6961 ctgaaaatct gggcgtgcaa actgtactac gaaaaaaacg cgcgtaacca gatcggtctg
7021 tggaacctgc gtgacaacgg tgttggtctg aacgttatgg tttctgaaca ctaccagtgc
7081 tgccgtaaaa tcttcatcca gtcttctcac aaccagctga acgaaaaccg ttggctggaa
7141 aaaaccctga aacgtgcgga aaaacgtcgt tctgaactgt ctatcatgat ccaggttaaa
7201 atcctgcaca ccaccaaatc tccggcggtt taaacttaat taacggcact cctcagccaa
7261 gtcaaaagcc tccgaccgga ggcttttgac tacatgccca tggcgtttac gccccgccct
7321 gccactcatc gcagtactgt tgtaattcat taagcattct gccgacatga aagccatcac
7381 aaacggcatg atgaacctga atcgccagcg gcatcagcac cttgtcgcct tgcgtataat
7441 atttgcccat agtgaaaacg ggggcgaaga agttgtccat attggccacg tttaaatcaa
7501 aactggtgaa actcacccag ggattggctg agacgaaaaa catattctca ataaacccct
7561 tagggaaata ggccaggttt tcaccgtaac acgccacatc ttgcgaatat atgtgtagaa
7621 actgccggaa atcgtcgtgg tattcactcc agagcgatga aaacgtttca gtttgctcat
7681 ggaaaacggt gtaacaaggg tgaacactat cccatatcac cagctcaccg tctttcattg
7741 ccatacggaa ctccggatga gcattcatca ggcgggcaag aatgtgaata aaggccggat
7801 aaaacttgtg cttattttc tttacggtct ttaaaaggc cgtaatatcc agctgaacgg
7861 tctggttata ggtacattTa gcaactgact gaaatgcctc aaaatgttct ttacgatgcc
7921 attgggatat atcaacggtg gtatatccag tgattttttt ctccattta gcttccttag
7981 ctcctgaaaa tctcgataac tcaaaaaata cgcccggtag tgatcttatt tcattatggt
8041 gaaagttgga acctcttacg tgccaAgcca aataggccgt
```

| DP6 |  |
|---|---|
| LOCUS pJC184 | 6537 bp DNA circular |
| FEATURES | Location/Qualifiers |
| modified_base | 852..866 |
|  | /note="USER junction" |
| terminator | 867..911 |
|  | /note="rrnB1 transcriptional terminator" |
| modified_base | 919..933 |
|  | /note="USER junction" |
| rep_origin | complement(39..777) |
|  | /dnas_title="cloDF13" |
|  | /vntifkey="33" |
|  | /label=cloDF13 |
| terminator | complement(7817..7852) |
|  | /note="P14/tonB bidirectional terminator" |
|  | /note="termination of cat transcript is slightly weaker than in opposite direction" |
| modified_base | 7853..7865 |
|  | /note="USER junction" |
| CDS | complement(7866..8525) |
|  | /note="cat (CmR)" |
|  | /note="from pACYCDuet-1" |
| modified_base | 7941..7941 |
|  | /note="mutation" |
|  | /note="annotated as a G in pACYCDuet cat marker annotation, here it is an A, but this mutation is silent from codon GTC (Val, 25% codon usage) to GTT (Val, 21% usage), so it should not be of functional relevance" |
| promoter | 8526..8623 |
|  | /note="cat promoter" |
|  | /note="from pACYCDuet-1" |
| modified_base | 8624..8639 |
|  | /note="USER junction" |
| CDS | complement(2885..3763) |
|  | /dnas_title="araC" |
|  | /vntifkey="4" |
|  | /label=araC |
| misc_feature | 2936..2936 |
|  | /note="originally an 'a' in annotation" |
| misc_feature | 2975..2975 |
|  | /note="originally a t in annotation" |
| misc_feature | 3041..3041 |
|  | /note="originally an a in annotation" |
| misc_feature | 3245..3245 |
|  | /note="originally a c in annotation" |
| misc_feature | 3410..3410 |
|  | /note="originally an a in annotation" |
| misc_feature | 3569..3569 |
|  | /note="originally a g in annotation" |
| misc_feature | 3716..3716 |
|  | /note="originally a g in annotation" |
| CDS | complement(934..2208) |
|  | /dnas_title="III" |
|  | /vntifkey="4" |
|  | /label=III |
| misc_feature | complement(1021..1066) |
|  | /note="modified to remove internal promoter" |
| misc_feature | 2423..2435 |
|  | /note="USER linker" |
| RBS | complement(2209..2222) |
|  | /note="sd8 RBS (from Ringquist and Gold Mol. Micro. 1992)" |
| modified_base | complement(2223..2237) |
|  | /note="USER junction" |
| terminator | complement(2443..2867) |
|  | /note="rrnB1 transcriptional terminator" |
| misc_feature | 2868..2884 |
|  | /note="USER linker" |
| modified_base | 789..806 |
|  | /note="User Junction" |
| misc_difference | 912..918 |
|  | /note="cloning scar" |
| protein_bind | complement(2408..2422) |
|  | /note="UAS II" |
| protein_bind | complement(2386..2404) |
|  | /note="UAS I" |
| prim_transcript | complement(2297..2297) |
|  | /note="Transcription Start Site" |
| enhancer | complement(2375..2422) |
|  | /note="Protected by pspF" |
| RBS | complement(2406..2415) |
|  | /note="pspF RBS" |
| promoter | 2356..2384 |
|  | /note="pspF P1" |
| promoter | 2375..2402 |
|  | /note="pspF P2" |
| promoter | 2242..2269 |
|  | /note="pspF P3" |
| −35_signal | 2242..2247 |
|  | /note="−35" |
| −10_signal | 2264..2269 |
|  | /note="−10" |
| −35_signal | 2356..2361 |
|  | /note="−35" |
| −35_signal | 2375..2380 |
|  | /note="−35" |
| −10_signal | 2379..2384 |
|  | /note="−10" |
| −10_signal | 2397..2402 |
|  | /note="−10" |
| prim_transcript | 2276..2276 |
|  | /note="" |
| prim_transcript | 2390..2390 |
|  | /note="" |
| prim_transcript | 2406..2406 |
|  | /note="" |
| promoter | complement(2308..2324) |
|  | /note="Sigma54 Core Promoter" |
| −35_signal | complement(2321..2322) |
|  | /note="−24" |
| −10_signal | complement(2309..2310) |
|  | /note="−12" |
| protein_bind | complement(2326..2358) |
|  | /note="High Affinity IHF Site" |
| protein_bind | complement(2278..2296) |
|  | /note="tetR binding site" |
| misc_feature | 3861..3861 |
|  | /dnas_title="C to A ***" |
|  | /vntifkey="21" |
|  | /label=C to A *** |
| misc_feature | 3779..3779 |
|  | /dnas_title="A to G ***" |
|  | /vntifkey="21" |
|  | /label=A to G *** |
| prim_transcript | complement(3927..3927) |
|  | /note="pC TSS" |
| protein_bind | 3950..3966 |
|  | /note="araO1" |
| protein_bind | 3929..3945 |
|  | /note="araO1" |
| protein_bind | 3792..3808 |
|  | /note="araO2" |
| protein_bind | 3971..3992 |
|  | /note="CAP" |
| misc_feature | 4051..4051 |
|  | /note="" |
| misc_feature | 4037..4037 |
|  | /note="" |
| prim_transcript | 4075..4075 |
|  | /note="pBAD TSS" |
| protein_bind | 4003..4019 |
|  | /note="araI1" |
| protein_bind | 4024..4040 |
|  | /note="araI2" |
| −10_signal | 4061..4066 |
|  | /note="−10" |
| −35_signal | 4037..4042 |
|  | /note="−35" |
| promoter | 3971..4100 |
|  | /dnas_title="pBAD" |
|  | /vntifkey="30" |
|  | /label=pBAD |

DP6

| | |
|---|---|
| LOCUS pJC184 | 6537 bp DNA circular |
| FEATURES | Location/Qualifiers |
| RBS | 4104..4123 |
| | /note="Native dnaQ RBS" |
| CDS | 4124..4855 |
| | /dnas_title="dnaQ926" |
| | /vntifkey="4" |
| | /label=dnaQ926 |
| conflict | 4157..4159 |
| | /note="D12A" |
| conflict | 4163..4165 |
| | /note="E14A" |
| RBS | 4865..4883 |
| | /note="Modified mutS RBS" |
| modified_base | 4865..4878 |
| | /note="USER Junction" |
| CDS | 4884..5720 |
| | /note="dam (wt)" |
| CDS | 5749..6294 |
| | /note="seqA (wt)" |
| RBS | 5729..5748 |
| | /note="seqA Native RBS" |
| CDS | 6323..6853 |
| | /note="emrR (wt)" |
| RBS | 6303..6322 |
| | /note="native emrR RBS" |
| modified_base | 6275..6292 |
| | /note="USER Junction" |
| CDS | 6882..7136 |
| | /note="PBS2 UGI" |
| RBS | 6861..6881 |
| | /note="Native UGI RBS" |
| modified_base | 6858..6877 |
| | /note="USER Junction" |
| RBS | 7145..7165 |
| | /note="dnaE RBS" |
| modified_base | 7141..7159 |
| | /note="USER Junction" |
| CDS | 7166..7792 |
| | /note="pmCDA1 (opt)" |
| modified_base | 7793..7809 |
| | /note="USER junction" |
| source | 1..8639 |

(SEQ ID NO: 35)

```
   1 cactcggtcg ctacgctccg ggcgtgagac tgcggcgggc gctgcggaca catacaaagt
  61 tacccacaga ttccgtggat aagcagggga ctaacatgtg aggcaaaaca gcagggccgc
 121 gccggtggcg ttttccata ggctccgccc tcctgccaga gttcacataa acagacgctt
 181 ttccggtgca tctgtgggag ccgtgaggct caaccatgaa tctgacagta cgggcgaaac
 241 ccgacaggac ttaaagatcc ccaccgtttc cggcgggtcg ctccctcttg cgctctcctg
 301 ttccgaccct gccgtttacc ggatacctgt tccgcctttc tcccttacgg gaagtgtggc
 361 gctttctcat agctcacaca ctggtatctc ggctcggtgt aggtcgttcg ctccaagctg
 421 ggctgtaagc aagaactccc cgttcagccc gactgctgcg ccttatccgg taactgttca
 481 cttgagtcca acccggaaaa gcacggtaaa acgccactgg cagcagccat tggtaactgg
 541 gagttcgcag aggatttgtt tagctaaaca cgcggttgct cttgaagtgt gcgccaaagt
 601 ccggctacac tggaaggaca gatttggttg ctgtgctctg cgaaagccag ttaccacggt
 661 taagcagttc cccaactgac ttaaccttcg atcaaaccac ctccccaggt ggtttttttcg
 721 tttacagggc aaaagattac gcgcagaaaa aaaggatctc aagaagatcc tttgatcttt
 781 tctactgaac cgctctagat ttcagtgcaa tttatctctt caaatgtagc acctgaagtc
 841 agcccaggag gaagaggaca tccggtcaaa taaaacgaaa ggctcagtcg aaagactggg
 901 cctttcgttt tGCTGAGGag acttagggac cctttaagac tccttattac gcagtatgtt
 961 agcaaacgta gaaaatacat acataaaggt ggcaacatat aaaagaaacg caaagacacc
1021 gcggaacagg ttgatcttat cgcagtcgat actgaactcg taaggtttac cagcgccaaa
1081 gacaaagggg cgacattcaa ccgattgagg gagggaaggt aaatattgac ggaaattatt
1141 cattaaaggt gaattatcac cgtcaccgac ttgagccatt tgggaattag agccagcaaa
1201 atcaccagta gcaccattac cattagcaag gccggaaacg tcaccaatga aaccatcgat
1261 agcagcaccg taatcagtag cgacagaatc aagtttgcct ttagcgtcag actgtagcgc
1321 gttttcatcg gcattttcgg tcatagcccc cttattagcg tttgccatct tttcataatc
1381 aaaatcaccg gaaccagagc caccaccgga accgcctccc tcagagccgc caccctcaga
```

```
1441 accgccaccc tcagagccac caccctcaga gccgccacca gaaccaccac cagagccgcc
1501 gccagcattg acaggaggtt gaggcaggtc agacgattgg ccttgatatt cacaaacgaa
1561 tggatcctca ttaaagccag aatggaaagc gcagtctctg aatttaccgt tccagtaagc
1621 gtcatacatg gcttttgatg atacaggagt gtactggtaa taagttttaa cggggtcagt
1681 gccttgagta acagtgcccg tataaacagt taatgccccc tgcctatttc ggaacctatt
1741 attctgaaac atgaaagtat taagaggctg agactcctca agagaaggat taggattagc
1801 gggggttttgc tcagtaccag gcggataagt gccgtcgaga gggttgatat aagtatagcc
1861 cggaataggt gtatcaccgt actcaggagg tttagtaccg ccaccctcag aaccgccacc
1921 ctcagaaccg ccaccctcag agccaccacc ctcattttca gggatagcaa gcccaatagg
1981 aacccatgta ccgtaacact gagtttcgtc accagtacaa actacaacgc ctgtagcatt
2041 ccacagacag ccctcatagt tagcgtaacg atctaaagtt ttgtcgtctt tccagacgtt
2101 agtaaatgaa ttttctgtat ggggttttgc taaacaactt tcaacagttt cagcggagtg
2161 agaatagaaa ggaacaacta aaggaattgc gaataataat tttttcattt ttttttttcct
2221 ttactgcacc tgcaggtaat gttgtcctct tgatttctgc gttcaggatt gtcctgctct
2281 ctatcactga tagggatgaa ctgttaatac aatttgcgtg ccaatttttt atctttttga
2341 tttataaaga tctgattgaa gaatcaacag caacatgcca ggatgagtta gcgaattaca
2401 ctaacaagtg gcgaatttca tcacggagcc aatgtcctca gcgagtttgt agaaacgcaa
2461 aaaggccatc cgtcaggatg gccttctgct taatttgatg cctggcagtt tatggcgggc
2521 gtcctgcccg ccaccctccg ggccgttgct tcgcaacgtt caaatccgct cccggcggat
2581 ttgtcctact caggagagcg ttcaccgaca acaacagat aaaacgaaag gcccagtctt
2641 tcgactgagc ctttcgtttt atttgatgcc tggcagttcc ctactctcgc atggggagac
2701 cccacactac catcggcgct acggcgtttc acttctgagt tcggcatggg gtcaggtggg
2761 accaccgcgc tactgccgcc aggcaaattc tgttttatca gaccgcttct gcgttctgat
2821 ttaatctgta tcaggctgaa atcttctct catccgccaa acagccagg gccctactga
2881 ctgtttatga caacttgacg gctacatcat tcacttttc ttcacaaccg gcacggaact
2941 cgctcgggct ggccccggtg catttttaa atacccgcga gaaatagagt tgatcgtcaa
3001 aaccaacatt gcgaccgacg gtggcgatag gcatccgggt ggtgctcaaa gcagcttcg
3061 cctggctgat acgttggtcc tcgcgccagc ttaagacgct aatccctaac tgctggcgga
3121 aaagatgtga cagacgcgac ggcgacaagc aaacatgctg tgcgacgctg gcgatatcaa
3181 aattgctgtc tgccaggtga tcgctgatgt actgacaagc ctcgcgtacc cgattatcca
3241 tcggtggatg gagcgactcg ttaatcgctt ccatgcgccg cagtaacaat tgctcaagca
3301 gatttatcgc cagcagctcc gaatagcgcc cttccccttg cccggcgtta atgatttgcc
3361 caaacaggtc gctgaaatgc ggctggtgcg cttcatccgg gcgaaagaac cccgtattgg
3421 caaatattga cggccagtta agccattcat gccagtaggc gcgcggacga aagtaaaccc
3481 actggtgata ccattcgcga gcctccggat gacgaccgta gtgatgaatc tctcctggcg
3541 ggaacagcaa atatcaccc ggtcggcaaa caaattctcg tccctgattt ttcaccaccc
3601 cctgaccgcg aatggtgaga ttgagaatat aacctttcat tcccagcggt cggtcgataa
3661 aaaaatcgag ataaccgttg gcctcaatcg cgttaaacc cgccaccaga tgggcattaa
3721 acgagtatcc cggcagcagg ggatcatttt gcgcttcagc catactttc atactcccac
3781 cattcagaga agaaaccaat tgtccatatt gcatcagaca ttgccgtcac tgcgtctttt
3841 actggctctt ctcgctaacc caaccggtaa ccccgcttat taaaagcatt ctgtaacaaa
```

-continued

```
3901 gcgggaccaa agccatgaca aaaacgcgta acaaaagtgt ctataatcac ggcagaaaag
3961 tccacattga ttatttgcac ggcgtcacac tttgctatgc catagcattt ttatccataa
4021 gattagcgga tcctacctga cgcttttat cgcaactctc tactgtttct ccatacccgt
4081 tttttggac gcgtacaact caagtctgac ataaatgacc gctatgagca ctgcaattac
4141 acgccagatc gttctcGCTa ccGCAaccac cggtatgaac cagattggtg cgcactatga
4201 aggccacaag atcattgaga ttggtgccgt tgaagtggtg aaccgtcgcc tgacgggcaa
4261 taacttccat gtttatctca aacccgatcg gctggtggat ccggaagcct ttggcgtaca
4321 tggtattgcc gatgaatttt tgctcgataa gcccacgttt gccgaagtag ccgatgagtt
4381 catggactat attcgcggcg cggagttggt gatccataac gcagcgttcg atatcggctt
4441 tatggactac gagttttcgt tgcttaagcg cgatattccg aagaccaata ctttctgtaa
4501 ggtcaccgat agccttgcgg tggcgaggaa aatgtttccc ggtaagcgca acagcctcga
4561 tgcgttatgt gctcgctacg aaatagataa cagtaaacga acgctgcacg gggcattact
4621 cgatgcccag atccttgcgg aagtttatct ggcgatgacc ggtggtcaaa cgtcgatggc
4681 ttttgcgatg gaaggagaga cacaacagca acaaggtgaa gcaacaattc agcgcattgt
4741 acgtcaggca agtaagttac gcgttgtttt tgcgacagat gaagagattg cagctcatga
4801 agcccgtctc gatctggtgc agaagaaagg cggaagttgc ctctggcgag cataatttaa
4861 tatcagtaaa ccggacataa cccatgaaga aaaatcgcgc ttttttgaag tgggcagggg
4921 gcaagtatcc cctgcttgat gatattaaac ggcatttgcc caagggcgaa tgtctggttg
4981 agccttttgt aggtgccggg tcggtgtttc tcaacaccga cttttctcgt tatatccttg
5041 ccgatatcaa tagcgacctg atcagtctct ataacattgt gaagatgcgt actgatgagt
5101 acgtacaggc cgcacgcgag ctgtttgttc ccgaaacaaa ttgcgccgag gtttactatc
5161 agttccgcga agagttcaac aaaagccagg atccgttccg tcgggcggta ctgttttat
5221 atttgaaccg ctacggttac aacggcctgt gtcgttacaa tctgcgcggt gagtttaacg
5281 tgccgttcgg ccgctacaaa aaaccctatt tcccggaagc agagttgtat cacttcgctg
5341 aaaaagcgca gaatgccttt ttctattgtg agtcttacgc cgatagcatg gcgcgcgcag
5401 atgatgcatc cgtcgtctat tgcgatccgc cttatgcacc gctgtctgcg accgccaact
5461 ttacggcgta tcacacaaac agttttacgc ttgaacaaca agcgcatctg gcggagatcg
5521 ccgaaggtct ggttgagcgc catattccag tgctgatctc caatcacgat acgatgttaa
5581 cgcgtgagtg gtatcagcgc gcaaaattgc atgtcgtcaa agttcgacgc agtataagca
5641 gcaacggcgg cacacgtaaa aaggtggacg aactgctggc tttgtacaaa ccaggagtcg
5701 tttcacccgc gaaaaaataa ttcagctaag acactgcact ggattaagat gaaaacgatt
5761 gaagttgatg atgaactcta cagctatatt gccagccaca ctaagcatat cggcgagagc
5821 gcatccgaca tttacggcg tatgttgaaa ttttccgccg catcacagcc tgctgctccg
5881 gtgacgaaag aggttcgcgt tgcgtcacct gctatcgtcg aagcgaagcc ggtcaaaacg
5941 attaaagaca aggttcgcgc aatgcgtgaa cttctgcttt cggatgaata cgcagagcaa
6001 aagcgagcgg tcaatcgctt tatgctgctg ttgtctacac tatattctct tgacgcccag
6061 gcgtttgccg aagcaacgga atcgttgcac ggtcgtacac gcgtttactt tgcggcagat
6121 gaacaaacgc tgctgaaaaa tggtaatcag accaagccga acatgtgcc aggcacgccg
6181 tattgggtga tcaccaacac caacaccggc cgtaaatgca gcatgatcga acacatcatg
6241 cagtcgatgc aattcccggc ggaattgatt gagaaggttt gcggaactat ctaacggctg
```

```
-continued
6301 aaattaatga ggtcataccc aaatggatag ttcgtttacg cccattgaac aaatgctaaa
6361 atttcgcgcc agccgccacg aagattttcc ttatcaggag atccttctga ctcgtctttg
6421 catgcacatg caaagcaagc tgctggagaa ccgcaataaa atgctgaagg ctcagggAat
6481 taacgagacg ttgtttatgg cgttgattac gctggagtct caggaaaacc acagtattca
6541 gccttctgaa ttaagttgtg ctcttggatc atcccgtacc aacgcgacgc gtattgccga
6601 tgaactggaa aaacgcggtt ggatcgaacg tcgtgaaagc gataacgatc gccgctgcct
6661 gcatctgcaa ttaacggaaa aaggtcacga gttttttgcgc gaggttttac caccgcagca
6721 taactgcctg catcaactct ggtccgcgct cagcacaaca gaaaaagatc agctcgagca
6781 aatcacccgc aaattgctct cccgtctcga ccagatggaa caagacggtg tggttctcga
6841 agcgatgagc taataataca aaaattagga ggaatttcaa catgacaaat ttatctgaca
6901 tcattgaaaa agaaacagga aaacaactag tgattcaaga atcaattcta atgttaccag
6961 aagaagtaga ggaagtaatt gggaataaac cagaaagtga tattttagtt catactgctt
7021 atgatgaaag tacagatgaa aatgtaatgc tattaacttc agatgctcca gaatataaac
7081 cttgggcttt agtaattcaa gacagtaatg gagaaaataa aattaaaatg ttataagtcg
7141 agattaagta aaccggaatc tgaagatgac cgacgcggaa tacgttcgta tccacgaaaa
7201 actggacatc tacaccttca aaaaacagtt cttcaacaac aaaaaatctg tttctcaccg
7261 ttgctacgtt ctgttcgaac tgaaacgtcg tggtgaacgt cgtgcgtgct tctggggtta
7321 cgcggttaac aaaccgcagt ctggtaccga acgtggtatc cacgcggaaa tcttctctat
7381 ccgtaaagtt gaagaatacc tgcgtgacaa cccgggtcag ttcaccatca actggtactc
7441 ttcttggtct ccgtgcgcgg actgcgcgga aaaaatcctg gaatggtaca accaggaact
7501 gcgtggtaac ggtcacaccc tgaaaatctg ggcgtgcaaa ctgtactacg aaaaaaacgc
7561 gcgtaaccag atcggtctgt ggaacctgcg tgacaacggt gttggtctga cgttatggt
7621 ttctgaacac taccagtgct gccgtaaaat cttcatccag tcttctcaca accagctgaa
7681 cgaaaaccgt tggctggaaa aaaccctgaa acgtgcggaa aaacgtcgtt ctgaactgtc
7741 tatcatgatc caggttaaaa tcctgcacac caccaaatct ccggcggttt aaacttaatt
7801 aacggcactc ctcagccaag tcaaaagcct ccgaccggag cttttgact acatgcccat
7861 ggcgtttacg ccccgccctg ccactcatcg cagtactgtt gtaattcatt aagcattctg
7921 ccgacatgga agccatcaca acggcatga tgaacctgaa tcgccagcgg catcagcacc
7981 ttgtcgcctt gcgtataata tttgcccata gtgaaaacgg gggcgaagaa gttgtccata
8041 ttggccacgt ttaaatcaaa actggtgaaa ctcacccagg gattggctga dcgaaaaac
8101 atattctcaa taaacccttt agggaaatag gccaggtttt caccgtaaca cgccacatct
8161 tgcgaatata tgtgtagaaa ctgccggaaa tcgtcgtggt attcactcca gagcgatgaa
8221 aacgtttcag tttgctcatg gaaaacggtg taacaagggt gaacactatc ccatatcacc
8281 agctcaccgt ctttcattgc catacggaac tccggatgag cattcatcag gcgggcaaga
8341 atgtgaataa aggccggata aaacttgtgc ttatttttct ttacggtctt aaaaaggcc
8401 gtaatatcca gctgaacggt ctggttatag gtacattTag caactgactg aaatgcctca
8461 aaatgttctt tacgatgcca ttgggatata tcaacggtgg tatatccagt gatttttttc
8521 tccattttag cttccttagc tcctgaaaat ctcgataact caaaaaatac gcccggtagt
8581 gatcttattt cattatggtg aaagttggaa cctcttacgt gccaAgccaa ataggccgt
```

Exemplary Sequences

Non-limiting sequences of exemplary encoding gene products that increase the mutation rate in a host cell, e.g., in a bacterial host cell, are provided below. Those of ordinary skill in the art will understand that other useful sequences for each of the gene products provided exist, e.g., sequences having one or more point mutations that do not affect the sequence or function of the encoded RNA or protein.

araC
(SEQ ID NO: 36)
```
atga caacttgacg gctacatcat tcactttttc ttcacaaccg
gcacggaact cgctcgggct ggccccggtg cattttttaa
atacccgcga gaaatagagt tgatcgtcaa aaccaacatt
gcgaccgacg gtggcgatag gcatccgggt ggtgctcaaa
agcagcttcg cctggctgat acgttggtcc tcgcgccagc
ttaagacgct aatccctaac tgctggcgga aaagatgtga
cagacgcgac ggcgacaagc aaacatgctg tgcgacgctg
gcgatatcaa aattgctgtc tgccaggtga tcgctgatgt
actgacaagc ctcgcgtacc cgattatcca tcggtggatg
gagcgactcg ttaatcgctt ccatgcgccg cagtaacaat
tgctcaagca gatttatcgc cagcagctcc gaatagcgcc
cttcccttg cccggcgtta atgatttgcc caaacaggtc
gctgaaatgc ggctggtgcg cttcatccgg gcgaaagaac
cccgtattgg caaatattga cggccagtta agccattcat
gccagtaggc gcgcggacga aagtaaaccc actggtgata
ccattcgcga gcctccggat gacgaccgta gtgatgaatc
tctcctggcg ggaacagcaa aatatcaccc ggtcggcaaa
caaattctcg tccctgattt ttcaccaccc cctgaccgcg
aatggtgaga ttgagaatat aacctttcat tcccagcggt
cggtcgataa aaaaatcgag ataaccgttg gcctcaatcg
gcgttaaacc cgccaccaga tgggcattaa acgagtatcc
cggcagcagg ggatcatttt gcgcttcagc cat
```
dnaQ926
(SEQ ID NO: 37)
```
atgag cactgcaatt acacgccaga tcgttctcGC TaccGCAacc
accggtatga accagattgg tgcgcactat gaaggccaca
agatcattga gattggtgcc gttgaagtgg tgaaccgtcg
cctgacgggc aataacttcc atgtttatct caaacccgat
cggctggtgg atccggaagc ctttggcgta catggtattg
ccgatgaatt tttgctcgat aagcccacgt ttgccgaagt
agccgatgag ttcatggact atattcgcgg cgcggagttg
gtgatccata acgcagcgtt cgatatcggc tttatggact
acgagttttc gttgcttaag cgcgatattc cgaagaccaa
tactttctgt aaggtcaccg atagccttgc ggtggcgagg
aaaatgtttc ccggtaagcg caacagcctc gatgcgttat
```
```
gtgctcgcta cgaaatagat aacagtaaac gaacgctgca
cgggggcatta ctcgatgccc agatccttgc ggaagtttat
ctggcgatga ccggtggtca aacgtcgatg gcttttgcga
tggaaggaga gacacaacag caacaaggtg aagcaacaat
tcagcgcatt gtacgtcagg caagtaagtt acgcgttgtt
tttgcgacag atgaagagat tgcagctcat gaagcccgtc
tcgatctggt gcagaagaaa ggcggaagtt gcctctggcg
agcataa
```
dam
(SEQ ID NO: 38)
```
atgaa gaaaaatcgc gcttttttga agtgggcagg gggcaagtat
cccctgcttg atgatattaa acggcatttg cccaagggcg
aatgtctggt tgagccttt gtaggtgccg ggtcggtgtt
tctcaacacc gacttttctc gttatatcct tgccgatatc
aatagcgacc tgatcagtct ctataacatt gtgaagatgc
gtactgatga gtacgtacag gccgcacgcg agctgtttgt
tcccgaaaca aattgcgccc aggtttacta tcagttccgc
gaagagttca acaaaagcca ggatccgttc cgtcgggcgg
tactgttttt atatttgaac cgctacggtt acaacggcct
gtgtcgttac aatctgcgcg gtgagtttaa cgtgccgttc
ggccgctaca aaaaacccta ttttcccggaa gcagagttgt
atcacttcgc tgaaaaagcg cagaatgcct tttctattg
tgagtcttac gccgatagca tggcgcgcgc agatgatgca
tccgtcgtct attgcgatcc gccttatgca ccgctgtctg
cgaccgccaa ctttacggcg tatcacacaa acagttttac
gcttgaacaa caagcgcatc tggcggagat cgccgaaggt
ctggttgagc gccatattcc agtgctgatc tccaatcacg
atacgatgtt aacgcgtgag tggtatcagc gcgcaaaatt
gcatgtcgtc aaagttcgac gcagtataag cagcaacggc
ggcacacgta aaaaggtgga cgaactgctg gctttgtaca
aaccaggagt cgtttcaccc gcgaaaaaat aa
```
seqA
(SEQ ID NO: 39)
```
atgaaaacga ttgaagttga tgatgaactc tacagctata
ttgccagcca cactaagcat atcggcgaga gcgcatccga
catttacgg cgtatgttga aattttccgc cgcatcacag
cctgctgctc cggtgacgaa agaggttcgc gttgcgtcac
ctgctatcgt cgaagcgaag ccggtcaaaa cgattaaaga
caaggttcgc gcaatgcgtg aacttctgct ttcggatgaa
tacgcagagc aaaagcgagc ggtcaatcgc tttatgctgc
tgttgtctac actatattct cttgacgccc aggcgtttgc
cgaagcaacg gaatcgttgc acggtcgtac acgcgtttac
```

-continued
```
tttgcggcag atgaacaaac gctgctgaaa aatggtaatc agaccaagcc gaaacatgtg ccaggcacgc cgtattgggt gatcaccaac accaacaccg gccgtaaatg cagcatgatc gaacacatca tgcagtcgat gcaattcccg gcggaattga ttgagaaggt ttgcggaact atctaa
``` emrR
(SEQ ID NO: 40)
```
atggat agttcgttta cgcccattga acaaatgcta aaatttcgcg ccagccgcca cgaagatttt ccttatcagg agatccttct gactcgtctt tgcatgcaca tgcaaagcaa gctgctggag aaccgcaata aaatgctgaa ggctcagggA attaacgaga cgttgtttat ggcgttgatt acgctggagt ctcaggaaaa ccacagtatt cagccttctg aattaagttg tgctcttgga tcatcccgta ccaacgcgac gcgtattgcc gatgaactgg aaaaacgcgg ttggatcgaa cgtcgtgaaa gcgataacga tcgccgctgc ctgcatctgc aattaacgga aaaaggtcac gagtttttgc gcgaggtttt accaccgcag cataactgcc tgcatcaact ctggtccgcg ctcagcacaa cagaaaaaga tcagctcgag caaatcaccc gcaaattgct ctcccgtctc gaccagatgg aacaagacgg tgtggttctc gaagcgatga gctaa
```

UGI
(SEQ ID NO: 41)
```
atgacaa atttatctga catcattgaa aaagaaacag gaaaacaact agtgattcaa gaatcaattc taatgttacc agaagaagta gaggaagtaa ttgggaataa accagaaagt gatattttag ttcatactgc ttatgatgaa agtacagatg aaaatgtaat gctattaact tcagatgctc cagaatataa accttgggct ttagtaattc aagacagtaa tggagaaaat aaaattaaaa tgttataa
```

CDA1
(SEQ ID NO: 42)
```
atg accgacgcgg aatacgttcg tatccacgaa aaactggaca tctacacctt caaaaaacag ttcttcaaca acaaaaaatc tgtttctcac cgttgctacg ttctgttcga actgaaacgt cgtggtgaac gtcgtgcgtg cttctggggt tacgcggtta acaaaccgca gtctggtacc gaacgtggta tccacgcgga aatcttctct atccgtaaag ttgaagaata cctgcgtgac aacccgggtc agttcaccat caactggtac tcttcttggt ctccgtgcgc ggactgcgcg gaaaaaatcc tggaatggta caaccaggaa ctgcgtggta acggtcacac cctgaaaatc tgggcgtgca aactgtacta cgaaaaaaac gcgcgtaacc agatcggtct gtggaacctg cgtgacaacg tgttggtct gaacgttatg gtttctgaac actaccagtg ctgccgtaaa
```

```
atcttcatcc agtcttctca caaccagctg aacgaaaacc gttggctgga aaaaaccctg aaacgtgcgg aaaaacgtcg ttctgaactg tctatcatga tccaggttaa aatcctgcac accaccaaat ctccggcggt ttaa
```

Drift Promoter
(SEQ ID NO: 124)
```
aat gttgtcctct tgatttctgc gttcaggatt gtcctgctct ctatcactga tagggatgaa ctgttaatac aatttgcgtg ccaatttttt atcttttttga tttataaaga tctgattgaa gaatcaacag caacatgcca ggatgagtta gcgaattaca ctaacaagtg gcgaatttca tc
```

REFERENCES

1. Lynch, M., Evolution of the mutation rate. Trends Genet, 2010. 26(8): p. 345-52.
2. Otto, S. P. and M. C. Whitlock, The probability of fixation in populations of changing size. Genetics, 1997. 146(2): p. 723-33.
3. Wong, T. S., D. Zhurina, and U. Schwaneberg, The diversity challenge in directed protein evolution. Comb Chem High Throughput Screen, 2006. 9(4): p. 271-88.
4. Tee, K. L. and T. S. Wong, Polishing the craft of genetic diversity creation in directed evolution. Biotechnol Adv, 2013. 31(8): p. 1707-21.
5. Badran, A. H. and D. R. Liu, In vivo continuous directed evolution. Curr Opin Chem Biol, 2014. 24C: p. 1-10.
6. Greener, A., M. Callahan, and B. Jerpseth, An efficient random mutagenesis technique using an *E. coli* mutator strain. Methods Mol Biol, 1996. 57: p. 375-85.
7. Rasila, T. S., M. I. Pajunen, and H. Savilahti, Critical evaluation of random mutagenesis by error-prone polymerase chain reaction protocols, *Escherichia coli* mutator strain, and hydroxylamine treatment. Anal Biochem, 2009. 388(1): p. 71-80.
8. Camps, M., et al., Targeted gene evolution in *Escherichia coli* using a highly error-prone DNA polymerase I. Proc Natl Acad Sci USA, 2003. 100(17): p. 9727-32.
9. Troll, C., et al., The mutagenic footprint of low-fidelity Pol I ColE1 plasmid replication in *E. coli* reveals an extensive interplay between Pol I and Pol III. Curr Genet, 2014. 60(3): p. 123-34.
10. Schaaper, R. M., Base selection, proofreading, and mismatch repair during DNA replication in *Escherichia coli*. J Biol Chem, 1993. 268(32): p. 23762-5.
11. Esvelt, K. M., J. C. Carlson, and D. R. Liu, A system for the continuous directed evolution of biomolecules. Nature, 2011. 472(7344): p. 499-503.
12. Carlson, J. C., et al., Negative selection and stringency modulation in phage-assisted continuous evolution. Nat Chem Biol, 2014. 10(3): p. 216-22.
13. Wong, T. S., et al., A statistical analysis of random mutagenesis methods used for directed protein evolution. J Mol Biol, 2006. 355(4): p. 858-71.
14. Horst, J. P., T. H. Wu, and M. G. Marinus, *Escherichia coli* mutator genes. Trends Microbiol, 1999. 7(1): p. 29-36.
15. Kang, S., et al., Interaction of SeqA and Dam methylase on the hemimethylated origin of *Escherichia coli* chromosomal DNA replication. J Biol Chem, 1999. 274(17): p. 11463-8.

16. Odsbu, I., et al., Specific N-terminal interactions of the *Escherichia coli* SeqA protein are required to form multimers that restrain negative supercoils and form foci. Genes Cells, 2005. 10(11): p. 1039-49.
17. Yang, H., et al., Identification of mutator genes and mutational pathways in *Escherichia coli* using a multicopy cloning approach. Mol Microbiol, 2004. 53(1): p. 283-95.
18. Schaaper, R. M. and M. Radman, The extreme mutator effect of *Escherichia coli* mutD5 results from saturation of mismatch repair by excessive DNA replication errors. EMBO J, 1989. 8(11): p. 3511-6.
19. Wu, T. H. and M. G. Marinus, Dominant negative mutator mutations in the mutS gene of *Escherichia coli*. J Bacteriol, 1994. 176(17): p. 5393-400.
20. Aronshtam, A. and M. G. Marinus, Dominant negative mutator mutations in the mutL gene of *Escherichia coli*. Nucleic Acids Res, 1996. 24(13): p. 2498-504.
21. Junop, M. S., et al., In vitro and in vivo studies of MutS, MutL and MutH mutants: correlation of mismatch repair and DNA recombination. DNA Repair (Amst), 2003. 2(4): p. 387-405.
22. Lada, A. G., et al., Mutator effects and mutation signatures of editing deaminases produced in bacteria and yeast. Biochemistry (Mosc), 2011. 76(1): p. 131-46.
23. Serrano-Heras, G., et al., Protein p56 from the *Bacillus subtilis* phage phi29 inhibits DNA-binding ability of uracil-DNA glycosylase. Nucleic Acids Res, 2007. 35(16): p. 5393-401.
24. Maki, H., J. Y. Mo, and M. Sekiguchi, A strong mutator effect caused by an amino acid change in the alpha subunit of DNA polymerase III of *Escherichia coli*. J Biol Chem, 1991. 266(8): p. 5055-61.
25. Gon, S., et al., Increase in dNTP pool size during the DNA damage response plays a key role in spontaneous and induced-mutagenesis in *Escherichia coli*. Proc Natl Acad Sci USA, 2011. 108(48): p. 19311-6.
26. Gabrovsky, V., M. L. Yamamoto, and J. H. Miller, Mutator effects in *Escherichia coli* caused by the expression of specific foreign genes. J Bacteriol, 2005. 187(14): p. 5044-8.
27. Mackie, A., et al., Addition of *Escherichia coli* K-12 growth observation and gene essentiality data to the EcoCyc database. J Bacteriol, 2014. 196(5): p. 982-8.
28. Kehoe, J. W. and B. K. Kay, Filamentous phage display in the new millennium. Chem Rev, 2005. 105(11): p. 4056-72.
29. Garibyan, L., et al., Use of the rpoB gene to determine the specificity of base substitution mutations on the *Escherichia coli* chromosome. DNA Repair (Amst), 2003. 2(5): p. 593-608.
30. Fijalkowska, I. J., R. L. Dunn, and R. M. Schaaper, Genetic requirements and mutational specificity of the *Escherichia coli* SOS mutator activity. J Bacteriol, 1997. 179(23): p. 7435-45.
31. Schaaper, R. M. and R. L. Dunn, Spectra of spontaneous mutations in *Escherichia coli* strains defective in mismatch correction: the nature of in vivo DNA replication errors. Proc Natl Acad Sci USA, 1987. 84(17): p. 6220-4.
32. Cupples, C. G. and J. H. Miller, A set of lacZ mutations in *Escherichia coli* that allow rapid detection of each of the six base substitutions. Proc Natl Acad Sci USA, 1989. 86(14): p. 5345-9.
33. Dickinson, B. C., et al., Experimental interrogation of the path dependence and stochasticity of protein evolution using phage-assisted continuous evolution. Proc Natl Acad Sci USA, 2013. 110(22): p. 9007-12.
34. Leconte, A. M., et al., A population-based experimental model for protein evolution: effects of mutation rate and selection stringency on evolutionary outcomes. Biochemistry, 2013. 52(8): p. 1490-9.
35. Dickinson, B. C., et al., A system for the continuous directed evolution of proteases rapidly reveals drug-resistance mutations. Nat Commun, 2014. 5: p. 5352.
36. Raskin, C. A., et al., Substitution of a single bacteriophage T3 residue in bacteriophage T7 RNA polymerase at position 748 results in a switch in promoter specificity. J Mol Biol, 1992. 228(2): p. 506-15.
37. Balashov S & Humayun M Z (2004) Specificity of spontaneous mutations induced in mutA mutator cells. *Mutation research* 548(1-2):9-18.
38. Stratagene (2004) Overcome mutational bias. *Strategies* 17:20-21.
39. Lai Y P, Huang J, Wang L F, Li J, & Wu Z R (2004) A new approach to random mutagenesis in vitro. *Biotechnology and bioengineering* 86(6):622-627.
40. Fijalkowska I J & Schaaper R M (1996) Mutants in the Exo I motif of *Escherichia coli* dnaQ: defective proofreading and inviability due to error catastrophe. *Proceedings of the National Academy of Sciences of the United States of America* 93(7):2856-2861.
41. Wijesinghe P & Bhagwat A S (2012) Efficient deamination of 5-methylcytosines in DNA by human APOBEC3A, but not by AID or APOBEC3G. *Nucleic acids research* 40(18):9206-9217.
42. Strauss B S, Roberts R, Francis L, & Pouryazdanparast P (2000) Role of the dinB gene product in spontaneous mutation in *Escherichia coli* with an impaired replicative polymerase. *Journal of bacteriology* 182(23):6742-6750.
43. Wechsler J A, et al. (1973) Isolation and characterization of thermosensitive *Escherichia coli* mutants defective in deoxyribonucleic acid replication. *Journal of bacteriology* 113(3):1381-1388.
44. Yang H, To K H, Aguila S J, & Miller J H (2006) Metagenomic DNA fragments that affect *Escherichia coli* mutational pathways. *Molecular microbiology* 61(4):960-977.
45. Pham P T, Zhao W, & Schaaper R M (2006) Mutator mutants of *Escherichia coli* carrying a defect in the DNA polymerase III tau subunit. *Molecular microbiology* 59(4):1149-1161.
46. Ahluwalia D, Bienstock R J, & Schaaper R M (2012) Novel mutator mutants of *E. coli* nrdAB ribonucleotide reductase: insight into allosteric regulation and control of mutation rates. *DNA repair* 11(5):480-487.
47. Dahlgren A & Ryden-Aulin M (2000) A novel mutation in ribosomal protein S4 that affects the function of a mutated RF1. *Biochimie* 82(8):683-691.
48. Herman G E & Modrich P (1981) *Escherichia coli* K-12 clones that overproduce dam methylase are hypermutable. *Journal of bacteriology* 145(1):644-646.
49. Glassner B J, Rasmussen L J, Najarian M T, Posnick L M, & Samson L D (1998) Generation of a strong mutator phenotype in yeast by imbalanced base excision repair. *Proceedings of the National Academy of Sciences of the United States of America* 95(17):9997-10002.
50. Klapacz J, et al. (2010) Frameshift mutagenesis and microsatellite instability induced by human alkyladenine DNA glycosylase. *Molecular cell* 37(6):843-853.
51. Wang M, Yang Z, Rada C, & Neuberger M S (2009) AID upmutants isolated using a high-throughput screen highlight the immunity/cancer balance limiting DNA deaminase activity. *Nature structural & molecular biology* 16(7):769-776.

52. Al Mamun A A (2007) Elevated expression of DNA polymerase II increases spontaneous mutagenesis in *Escherichia coli. Mutation research* 625(1-2):29-39.
53. Luan G, Cai Z, Li Y, & Ma Y (2013) Genome replication engineering assisted continuous evolution (GREACE) to improve microbial tolerance for biofuels production. *Biotechnology for biofuels* 6(1):137.
54. Posnick L M & Samson L D (1999) Imbalanced base excision repair increases spontaneous mutation and alkylation sensitivity in *Escherichia coli. Journal of bacteriology* 181(21):6763-6771.
55. Ren L, Al Mamun A A, & Humayun M Z (1999) The mutA mistranslator tRNA-induced mutator phenotype requires recA and recB genes, but not the derepression of lexA-regulated functions. *Molecular microbiology* 32(3): 607-615.
56. Petersen-Mahrt S K, Harris R S, & Neuberger M S (2002) AID mutates *E. coli* suggesting a DNA deamination mechanism for antibody diversification. *Nature* 418 (6893):99-103.
57. Harris R S, Petersen-Mahrt S K, & Neuberger M S (2002) RNA editing enzyme APOBEC1 and some of its homologs can act as DNA mutators. *Molecular cell* 10(5): 1247-1253.
58. Hasegawa K, Yoshiyama K, & Maki H (2008) Spontaneous mutagenesis associated with nucleotide excision repair in *Escherichia coli. Genes to cells: devoted to molecular & cellular mechanisms* 13(5):459-469.
59. *Kohli* R M, et al. (2009) A portable hot spot recognition loop transfers sequence preferences from APOBEC family members to activation-induced cytidine deaminase. *The Journal of biological chemistry* 284(34):22898-22904.
60. Shindo K, et al. (2012) A Comparison of Two Single-Stranded DNA Binding Models by Mutational Analysis of APOBEC3G. *Biology* 1(2):260-276.
61. Yeung T C, Beaulieu B B, Jr., McLafferty M A, & Goldman P (1984) Interaction of metronidazole with DNA repair mutants of *Escherichia coli. Antimicrobial agents and chemotherapy* 25(1):65-70.

All publications, patents, patent applications, publication, and database entries (e.g., sequence database entries) mentioned herein, e.g., in the Background, Summary, Detailed Description, Examples, and/or References sections, are hereby incorporated by reference in their entirety as if each individual publication, patent, patent application, publication, and database entry was specifically and individually incorporated herein by reference. In case of conflict, the present application, including any definitions herein, will control.

EQUIVALENTS AND SCOPE

Those skilled in the art will recognize, or be able to ascertain using no more than routine experimentation, many equivalents of the embodiments described herein. The scope of the present disclosure is not intended to be limited to the above description, but rather is as set forth in the appended claims.

Articles such as "a," "an," and "the" may mean one or more than one unless indicated to the contrary or otherwise evident from the context. Claims or descriptions that include "or" between two or more members of a group are considered satisfied if one, more than one, or all of the group members are present, unless indicated to the contrary or otherwise evident from the context. The disclosure of a group that includes "or" between two or more group members provides embodiments in which exactly one member of the group is present, embodiments in which more than one members of the group are present, and embodiments in which all of the group members are present. For purposes of brevity those embodiments have not been individually spelled out herein, but it will be understood that each of these embodiments is provided herein and may be specifically claimed or disclaimed.

It is to be understood that the invention encompasses all variations, combinations, and permutations in which one or more limitation, element, clause, or descriptive term, from one or more of the claims or from one or more relevant portion of the description, is introduced into another claim. For example, a claim that is dependent on another claim can be modified to include one or more of the limitations found in any other claim that is dependent on the same base claim. Furthermore, where the claims recite a composition, it is to be understood that methods of making or using the composition according to any of the methods of making or using disclosed herein or according to methods known in the art, if any, are included, unless otherwise indicated or unless it would be evident to one of ordinary skill in the art that a contradiction or inconsistency would arise.

Where elements are presented as lists, e.g., in Markush group format, it is to be understood that every possible subgroup of the elements is also disclosed, and that any element or subgroup of elements can be removed from the group. It is also noted that the term "comprising" is intended to be open and permits the inclusion of additional elements or steps. It should be understood that, in general, where an embodiment, product, or method is referred to as comprising particular elements, features, or steps, embodiments, products, or methods that consist, or consist essentially of, such elements, features, or steps, are provided as well. For purposes of brevity those embodiments have not been individually spelled out herein, but it will be understood that each of these embodiments is provided herein and may be specifically claimed or disclaimed.

Where ranges are given, endpoints are included. Furthermore, it is to be understood that unless otherwise indicated or otherwise evident from the context and/or the understanding of one of ordinary skill in the art, values that are expressed as ranges can assume any specific value within the stated ranges in some embodiments, to the tenth of the unit of the lower limit of the range, unless the context clearly dictates otherwise. For purposes of brevity, the values in each range have not been individually spelled out herein, but it will be understood that each of these values is provided herein and may be specifically claimed or disclaimed. It is also to be understood that unless otherwise indicated or otherwise evident from the context and/or the understanding of one of ordinary skill in the art, values expressed as ranges can assume any subrange within the given range, wherein the endpoints of the subrange are expressed to the same degree of accuracy as the tenth of the unit of the lower limit of the range.

In addition, it is to be understood that any particular embodiment of the present invention may be explicitly excluded from any one or more of the claims. Where ranges are given, any value within the range may explicitly be excluded from any one or more of the claims. Any embodiment, element, feature, application, or aspect of the compositions and/or methods of the invention, can be excluded from any one or more claims. For purposes of brevity, all of the embodiments in which one or more elements, features, purposes, or aspects is excluded are not set forth explicitly herein.

SEQUENCE LISTING (124 sequences)

SEQ ID NO: 1 - DNA, 6407 bp, Artificial Sequence
  Synthetic Polynucleotide
aacgctactactattagtagaattgatgccaccttttcagctcgcgccccaaatgaaaatatagctaaacaggttattgaccatttgcgaaatgtatctaatggtcaaactaaatctactcgttcgcagaattgggaatcaactgttacatggaatgaaacttccagacaccgtactttagttgcatatttaaaacatgttgagctacagcaccagattcagcaattaagctctaagccatccgcaaaaatgacctcttatcaaaaggagcaattaaaggtactctctaatcctgacctgttggagtttgcttccggtctggttcgctttgaagctcgaattaaaacgcgatatttgaagtctttcgggcttcctcttaatctttttgatgcaatccgctttgcttctgactataatagtcagggtaaagacctgatttttgatttatggtcattctcgttttctgaactgtttaaagcatttgagggggattcaatgaatatttatgacgattccgcagtattggacgctatccagtctaaacattttactattaccccctctggcaaaacttcttttgcaaaagcctctcgctattttggtttttatcgtcgtctggtaaacgagggttatgatagtgttgctcttactatgcctcgtaattccttttggcgttatgtatctgcattagttgaatgtggtattcctaaatctcaactgatgaatctttctacctgtaataatgttgttccgttagttcgttttattaacgtagatttttcttcccaacgtcctgactggtataatgagccagttcttaaaatcgcataaggtaattcacaatgattaaagttgaaattaaaccatctcaagcccaatttactactcgttctggtgtttctcgtcagggcaagccttattcactgaatgagcagctttgttacgttgatttgggtaatgaatatccggttcttgtcaagattactcttgatgaaggtcagccagcctatgcgcctggtctgtacaccgttcatctgtcctctttcaaagttggtcagttcggttcccttatgattgaccgtctgcgcctcgttccggctaagtaacatggagcaggtcgcggatttcgacacaatttatcaggcgatgatacaaatctccgttgtactttgtttcgcgcttggtataatcgctgggggtcaaagatgagtgttttagtgtattctttcgcctctttcgttttaggttggtgccttcgtagtggcattacgtattttacccgtttaatggaaacttcctcatgaaaaagtctttagtcctcaaagcctctgtagccgttgctaccctcgttccgatgctgtctttcgctgctgagggtgacgatcccgcaaaagcggcctttaactccctgcaagcctcagcgaccgaatatatcggttatgcgtgggcgatggttgttgtcattgtcggcgcaactatcggtatcaagctgtttaagaaattcacctcgaaagcaagctgataaaccgatacaattaaaggctccttttggagcctttttttttggagattttcaacatgaaaaaattattattcgcaattcctttagttgttcctttctattctcactccgctgaaactgttgaaagttgtttagcaaaaccccatacagaaaattcatttactaacgtctggaaagacgacaaaactttagatcgttacgctaactatgagggttgtctgtggaatgctacaggcgttgtagtttgtactggtgacgaaactcagtgttacggtacatgggttcctattgggcttgctatccctgaaaatgagggtggtggctctgagggtggcggttctgagggtggcggttctgagggtggcggtactaaacctcctgagtacggtgatacacctattccgggctatacttatatcaaccctctcgacggcacttatccgcctggtactgagcaaaaccccgctaatcctaatccttctcttgaggagtctcagcctcttaatactttcatgtttcagaataataggttccgaaataggcagggggcattaactgtttatacgggcactgttactcaaggcactgaccccgttaaaacttattaccagtacactcctgtatcatcaaaagccatgtatgacgcttactggaacggtaaattcagagactgcgctttccattctggctttaatgaggatccattcgtttgtgaatatcaaggccaatcgtctgacctgcctcaacctcctgtcaatgctggcggcggctctggtggtggttctggtggcggctctgagggtggtggctctgagggtggcggttctgagggtggcggctctgagggaggcggttccggtggtggctctggttccggtgattttgattatgaaaagatggcaaacgctaataagggggctatgaccgaaaatgccgatgaaaacgcgctacagtctgacgctaaaggcaaacttgattctgtcgctactgattacggtgctgctatcgatggtttcattggtgacgtttccggccttgctaatggtaatggtgctactggtgattttgctggctctaattcccaaatggctcaagtcggtgacggtgataattcacctttaatgaataatttccgtcaatatttaccttccctccctcaatcggttgaatgtcgcccttttgtctttagcgctggtaaaccatatgaattttctattgattgtgacaaaataaacttattccgtggtgtctttgcgtttcttttatatgttgccacctttatgtatgtattttctacgtttgctaacatactgcgtaataaggagtcttaatcatgccagttcttttgggtattccgttattattgcgtttcctcggtttccttctggtaactttgttcggctatctgcttacttttcttaaaaagggcttcggtaagatagctattgctatttcattgtttcttgctcttattattgggcttaactcaattcttgtgggttatctctctgatattagcgctcaattaccctctgactttgttcagggtgttcagttaattctcccgtctaatgcgcttccctgtttttatgttattctctctgtaaaggctgctattttcatttttgacgttaaacaaaaaatcgtttcttatttggattgggataaataatatggctgtttattttgtaactggcaaattaggctctggaaagacgctcgttagcgttggtaagattcaggataaaattgtagctgggtgcaaaatagcaactaatcttgatttaaggcttcaaaacctcccgcaagtcgggaggttcgctaaaacgcctcgcgttcttagaataccggataagccttctatatctgatttgcttgctattgggcgcggtaatgattcctacgatgaaaataaaaacggcttgcttgttctcgatgagtgcggtacttggtttaatacccgttcttggaatgataaggaaagacagccgattattgattggtttctacatgctcgtaaattaggatgggatattatttttcttgttcaggacttatctattgttgataaacaggcgcgttctgcattagctgaacatgttgtttattgtcgtcgtctggacagaattactttaccttttgtcggtactttatattctcttattactggctcgaaaatgcctctgcctaaattacatgttggcgttgttaaatatggcgattctcaattaagccctactgttgagcgttggctttatactggtaagaatttgtataacgcatatgatactaaacaggctttttctagtaattatgattccggtgtttattcttatttaacgccttatttatcacacggtcggtatttcaaaccattaaatttaggtcagaagatgaaattaactaaaatatatttgaaaaagttttctcgcgttctttgtcttgcgattggatttgcatcagcatttacatatagttatataacccaacctaagccggaggttaaaaaggtagtctctcagacctatgattttgataaattcactattgactcttctcagcgtcttaatctaagctatcgctatgttttcaaggattctaagggaaaattaattaatagcgacgatttacagaagcaaggttattcactcacatatattgatttatgtactgtttccattaaaaaaggtaattcaaatgaaattgttaaatgtaattaattttgttttcttgatgtttgtttcatcatcttcttttgctcaggtaattgaaatgaataattcgcctctgcgcgattttgtaacttggtattcaaagcaatcaggcgaatccgttattgtttctcccgatgtaaaaggtactgttactgtatattcatctgacgttaaacctgaaaatctacgcaatttctttatttctgttttacgtgctaataattttgatatggttggttcaattccttccataattcagaagtataatccaaacaatcaggattatattgatgaattgccatcatctgataatcaggaatatgatgataattccgctccttctggtggtttctttgttccgcaaaatgataatgttactcaaacttttaaaattaataacgttcgggcaaaggatttaatacgagttgtcgaattgtttgtaaagtctaatacttctaaatcctcaaatgtattatctattgacggctctaatctattagttgttagtgcacctaaagatattttagataaccttcctcaattcctttctactgttgatttgccaactgaccagatattgattgagggtttgatatttgaggttcagcaaggtgatgctttagatttttcatttgctgctggctctcagcgtggcactgttgcaggcggtgttaatactgaccgcctcacctctgttttatcttctgctggtggttcgttcggtatttttaatggcgatgttttagggctatcagttcgcgcattaaagactaatagccattcaaaaatattgtctgtgccacgtattcttacgctttcaggtcagaagggttctatctctgttggccagaatgtcccttttattactggtcgtgtgactggtgaatctgccaatgtaaataatccatttcagacgattgagcgtcaaaatgtaggtatttccatgagcgtttttcctgttgcaatggctggcggtaatattgttctggatattaccagcaaggccgatagtttgagttcttctactcaggcaagtgatgttattactaatcaaagaagtattgctacaacggttaatttgcgtgatggacagactcttttactcggtggcctcactgattataaaaacacttctcaagattctggcgtaccgttcctgtctaaaatccctttaatcggcctcctgtttagctcccgctctgattccaacgaggaaagcacgttatacgtgctcgtcaaagcaaccatagtacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgatttgggtgatggttcacgtagtgggccatcgccctgatagacggtttttcgccctttgacgttggagtccacgttctttaatagtggactcttgttccaaactggaacaacactcaaccctatctcgggctattcttttgatttataagggattttgccgatttcggcctattggttaaaaaatgagctgatttaacaaaaatttaacgcgaattttaacaaaatattaacgtttacaatttaaatatttgcttatacaatcttcctgtttttggggcttttctgattatcaaccggggtacatatgattgacatgctagttttacgattaccgttcatcgattctcttgtttgctccagactctcaggcaatgacctgatagcctttgtagacctctcaaaaatagctaccctctccggcatgaatttatcagctagaacggttgaatatcatattgatggtgatttgactgtctccggcctttctcacccttttgaatctttacctacacattactcaggcattgcatttaaaatatatgagggttctaaaaatttttatccttgcgttgaaataaaggcttctcccgcaaaagtattacagggtcataatgtttttggtacaaccgatttagctttatgctctgaggctttattgcttaattttgctaattctttgccttgcctgtatgatttattggatgtt

SEQ ID NO: 2 - protein, 410 aa, Artificial Sequence
  Synthetic Polypeptide
MIDMLVLRLPFIDSLVCSRLSGNDLIAFVDLSKIATLSGMNLSARTVEYHIDGDLTVSGLSHPFESLPTHYSGIAFKIYEGSKNFYPCVEIKASPAKVLQGHNVFGTTDLALCSEALLLNFANSLPCLYDLLDVNATTISRIDATFSARAPNENIAKQVIDHLRNVSNGQTKSTRSQNWESTVTWNETSRHRTLVAYLKHVELQHQIQQLSSKPSAKMTSYQKEQLKVLSNPDLLEFASGLVRFEARIKTRYLKSFGLPLNLFDAIRFASDYNSQGKDLIFDLWSFSFSELFKAFEGDSMNIYDDSAVLDAIQSKHFTITPSGKTSFAKASRYFGFYRRLVNEGYDSVALTMPRNSFWRYVSALVECGIPKSQLMNLSTCNNVVPLVRFINVDFSSQRPDWYNEPVLKIA

SEQ ID NO: 3 - protein, 111 aa, Artificial Sequence
  Synthetic Polypeptide
MNIYDDSAVLDAIQSKHFTITPSGKTSFAKASRYFGFYRRLVNEGYDSVALTMPRNSFWRYVSALVECGIPKSQLMNLSTCNNVVPLVRFINVDFSSQRPDWYNEPVLKIA

SEQ ID NO: 4 - protein, 87 aa, Artificial Sequence
  Synthetic Polypeptide
MIKVEIKPSQAQFTTRSGVSRQGKPYSLNEQLCYVDLGNEYPVLVKITLDEGQPAYAPGLYTVHLSSFKVGQFGSLMIDRLRLVPAK

SEQ ID NO: 5 - protein, 33 aa, Artificial Sequence
  Synthetic Polypeptide
MEQVADFDTIYQAMIQISVVLCFALGIIAGGQR

SEQ ID NO: 6 - protein, 32 aa, Artificial Sequence
  Synthetic Polypeptide
MSVLVYSFASFVLGWCLRSGITYFTRLMETSS

SEQ ID NO: 7 - protein, 73 aa, Artificial Sequence
  Synthetic Polypeptide
MKKSLVLKASVAVATLVPMLSFAAEGDDPAKAAFNSLQASATEYIGYAWAMVVVIVGATIGIKLFKKFTSKAS

SEQ ID NO: 8 - protein, 424 aa, Artificial Sequence
  Synthetic Polypeptide
MKKLLFAIPLVVPFYSHSAETVESCLAKPHTENSFTNVWKDDKTLDRYANYEGCLWNATGVVVCTGDETQCYGTWVPIGLAIPENEGGGSEGGGSEGGGSEGGGTKPPEYGDTPIPGYTYINPLDGTYPPGTEQNPANPNPSLEESQPLNTFMFQNNRFRNRQGALTVYTGTVTQGTDPVKTYYQYTPVSSKAMYDAYWNGKFRDCAFHSGFNEDPFVCEYQGQSSDLPQPPVNAGGGSGGGSGGGSEGGGSEGGGSEGGGSEGGGSGGGSGSGDFDYEKMANANKGAMTENADENALQSDAKGKLDSVATDYGAAIDGFIGDVSGLANGNGATGDFAGSNSQMAQVGDGDNSPLMNNFRQYLPSLPQSVECRPFVFSAGKPYEFSIDCDKINLFRGVFAFLLYVATFMYVFSTFANILRNKES

SEQ ID NO: 9 - protein, 112 aa, Artificial Sequence
  Synthetic Polypeptide
MPVLLGIPLLLRFLGFLLVTLFGYLLTFLKKGFGKIAIAISLFLALIIGLNSILVGYLSDISAQLPSDFVQGVQLILPSNALPCFYVILSVKAAIFIFDVKQKIVSYLDWDK

SEQ ID NO: 10 - protein, 348 aa, Artificial Sequence
  Synthetic Polypeptide
MAVYFVTGKLGSGKTLVSVGKIQDKIVAGCKIATNLDLRLQNLPQVGRFAKTPRVLRIPDKPSISDLLAIGRGNDSYDENKNGLLVLDECGTWFNTRSWNDKERQPIIDWFLHARKLGWDIIFLVQDLSIVDKQARSALAEHVVYCRRLDRITLPFVGTLYSLITGSKMPLPKLHVGVVKYGDSQLSPTVERWLYTGKNLYNAYDTKQAFSSNYDSGVYSYLTPYLSHGRYFKPLNLGQKMKLTKIYLKKFSRVLCLAIGFASAFTYSYITQPKPEVKKVVSQTYDFDKFTIDSSQRLNLSYRYVFKDSKGKLINSDDLQKQGYSLTYIDLCTVSIKKGNSNEIVKCN

SEQ ID NO: 11 - protein, 426 aa, Artificial Sequence
  Synthetic Polypeptide
MKLLNVINFVFLMFVSSSSFAQVIEMNNSPLRDFVTWYSKQSGESVIVSPDVKGTVTVYSSDVKPENLRNFFISVLRANNFDMVGSIPSIIQKYNPNNQDYIDELPSSDNQEYDDNSAPSGGFFVPQNDNVTQTFKINNVRAKDLIRVVELFVKSNTSKSSNVLSIDGSNLLVVSAPKDILDNLPQFLSTVDLPTDQILIEGLIFEVQQGDALDFSFAAGSQRGTVAGGVNTDRLTSVLSSAGGSFGIFNGDVLGLSVRALKTNSHSKILSVPRILTLSGQKGSISVGQNVPFITGRVTGESANVNNPFQTIERQNVGISMSVFPVAMAGGNIVLDITSKADSLSSSTQASDVITNQRSIATTVNLRDGQTLLLGGLTDYKNTSQDSGVPFLSKIPLIGLLFSSRSDSNEESTLYVLVKATIVRAL

SEQ ID NO: 12 - DNA, 91 bp, Artificial Sequence
  Synthetic Polynucleotide
gatctggtgcagaagaaaggcggaagttgcctctggcgagcataatttaatatcagtaaaccggacataacccatgaagaaaaatcgcgct

SEQ ID NO: 13 - DNA, 91 bp, Artificial Sequence
  Synthetic Polynucleotide
agcgcgatttttcttcatgggttatgtccggtttactgatattaaattatgctcgccagaggcaacttccgcctttcttctgcaccagatc

SEQ ID NO: 14 - protein, 14 aa, Artificial Sequence
  Synthetic Polypeptide
DLVQKKGGSCLWRA

SEQ ID NO: 15 - protein, 6 aa, Artificial Sequence
  Synthetic Polypeptide
MKKNRA

SEQ ID NO: 16 - DNA, 91 bp, Artificial Sequence
  Synthetic Polynucleotide
caattcccggcggaattgattgagaaggtttgcggaactatctaataatacaaaaattaggaggaatttcaacatgacaaatttatctgac

SEQ ID NO: 17 - DNA, 91 bp, Artificial Sequence
  Synthetic Polynucleotide
gtcagataaatttgtcatgttgaaattcctcctaatttttgtattattagatagttccgcaaaccttctcaatcaattccgccgggaattg

SEQ ID NO: 18 - protein, 14 aa, Artificial Sequence
  Synthetic Polypeptide
QFPAELIEKVCGTI

SEQ ID NO: 19 - protein, 6 aa, Artificial Sequence
  Synthetic Polypeptide
MTNLSD

SEQ ID NO: 20 - DNA, 22 bp, Artificial Sequence
  Synthetic Polynucleotide
aatgtcaaatccgtggcgtgac

SEQ ID NO: 21 - DNA, 24 bp, Artificial Sequence
  Synthetic Polynucleotide
ttcacccggatacatctcgtcttc

SEQ ID NO: 22 - DNA, 22 bp, Artificial Sequence
  Synthetic Polynucleotide
cggaaggcaccgtaaaagacat

SEQ ID NO: 23 - DNA, 21 bp, Artificial Sequence
  Synthetic Polynucleotide
cgtgtagagcgtgcggtgaaa

SEQ ID NO: 24 - DNA, 19 bp, Artificial Sequence
  Synthetic Polynucleotide
ggcgctggtaaaccatatg

SEQ ID NO: 25 - DNA, 19 bp, Artificial Sequence
  Synthetic Polynucleotide
ggaaaccgaggaaacgcaa

SEQ ID NO: 26 - DNA, 6681 bp, Artificial Sequence
  Synthetic Polynucleotide
cactcggtcgctacgctccgggcgtgagactgcggcgggcgctgcggacacatacaaagttacccacagattccgtggataagcaggggactaacatgtgaggcaaaacagcagggccgcgccggtggcgtttttccataggctccgccctcctgccagagttcacataaacagacgcttttccggtgcatctgtgggagccgtgaggctcaaccatgaatctgacagtacgggcgaaacccgacaggacttaaagatccccaccgtttccggcgggtcgctccctcttgcgctctcctgttccgaccctgccgtttaccggatacctgttccgcctttctcccttacgggaagtgtggcgctttctcatagctcacacactggtatctcggctcggtgtaggtcgttcgctccaagctgggctgtaagcaagaactccccgttcagcccgactgctgcgccttatccggtaactgttcacttgagtccaacccggaaaagcacggtaaaacgccactggcagcagccattggtaactgggagttcgcagaggatttgtttagctaaacacgcggttgctcttgaagtgtgcgccaaagtccggctacactggaaggacagatttggttgctgtgctctgcgaaagccagttaccacggttaagcagttccccaactgacttaaccttcgatcaaaccacctccccaggtggttttttcgtttacagggcaaaagattacgcgcagaaaaaaaggatctcaagaagatcctttgatcttttctactgaaccgctctagatttcagtgcaatttatctcttcaaatgtagcacctgaagtcagcccaggaggaagaggacatccggtcaaataaaacgaaaggctcagtcgaaagactgggcctttcgttttagacttagggaccctttatgacaacttgacggctacatcattcactttttcttcacaaccggcacggaactcgctcgggctggccccggtgcattttttaaatacccgcgagaaatagagttgatcgtcaaaaccaacattgcgaccgacggtggcgataggcatccgggtggtgctcaaaagcagcttcgcctggctgatacgttggtcctcgcgccagcttaagacgctaatccctaactgctggcggaaaagatgtgacagacgcgacggcgacaagcaaacatgctgtgcgacgctggcgatatcaaaattgctgtctgccaggtgatcgctgatgtactgacaagcctcgcgtacccgattatccatcggtggatggagcgactcgttaatcgcttccatgcgccgcagtaacaattgctcaagcagatttatcgccagcagctccgaatagcgcccttccccttgcccggcgttaatgatttgcccaaacaggtcgctgaaatgcggctggtgcgcttcatccgggcgaaagaaccccgtattggcaaatattgacggccagttaagccattcatgccagtaggcgcgcggacgaaagtaaacccactggtgataccattcgcgagcctccggatgacgaccgtagtgatgaatctctcctggcgggaacagcaaaatatcacccggtcggcaaacaaattctcgtccctgatttttcaccaccccctgaccgcgaatggtgagattgagaatataacctttcattcccagcggtcggtcgataaaaaaatcgagataaccgttggcctcaatcggcgttaaacccgccaccagatgggcattaaacgagtatcccggcagcaggggatcattttgcgcttcagccatacttttcatactcccaccattcagagaagaaaccaattgtccatattgcatcagacattgccgtcactgcgtcttttactggctcttctcgctaacccaaccggtaaccccgcttattaaaagcattctgtaacaaagcgggaccaaagccatgacaaaaacgcgtaacaaaagtgtctataatcacggcagaaaagtccacattgattatttgcacggcgtcacactttgctatgccatagcatttttatccataagattagcggatcctacctgacgctttttatcgcaactctctactgtttctccatacccgtttttttggacgcgtacaactcaagtctgacataaatgaccgctatgagcactgcaattacacgccagatcgttctcgctaccgcaaccaccggtatgaaccagattggtgcgcactatgaaggccacaagatcattgagattggtgccgttgaagtggtgaaccgtcgcctgacgggcaataacttccatgtttatctcaaacccgatcggctggtggatccggaagcctttggcgtacatggtattgccgatgaatttttgctcgataagcccacgtttgccgaagtagccgatgagttcatggactatattcgcggcgcggagttggtgatccataacgcagcgttcgatatcggctttatggactacgagttttcgttgcttaagcgcgatattccgaagaccaatactttctgtaaggtcaccgatagccttgcggtggcgaggaaaatgtttcccggtaagcgcaacagcctcgatgcgttatgtgctcgctacgaaatagataacagtaaacgaacgctgcacggggcattactcgatgcccagatccttgcggaagtttatctggcgatgaccggtggtcaaacgtcgatggcttttgcgatggaaggagagacacaacagcaacaaggtgaagcaacaattcagcgcattgtacgtcaggcaagtaagttacgcgttgtttttgcgacagatgaagagattgcagctcatgaagcccgtctcgatctggtgcagaagaaaggcggaagttgcctctggcgagcataatttaatatcagtaaaccggacataacccatgaagaaaaatcgcgcttttttgaagtgggcagggggcaagtatcccctgcttgatgatattaaacggcatttgcccaagggcgaatgtctggttgagccttttgtaggtgccgggtcggtgtttctcaacaccgacttttctcgttatatccttgccgatatcaatagcgacctgatcagtctctataacattgtgaagatgcgtactgatgagtacgtacaggccgcacgcgagctgtttgttcccgaaacaaattgcgccgaggtttactatcagttccgcgaagagttcaacaaaagccaggatccgttccgtcgggcggtactgtttttatatttgaaccgctacggttacaacggcctgtgtcgttacaatctgcgcggtgagtttaacgtgccgttcggccgctacaaaaaaccctatttcccggaagcagagttgtatcacttcgctgaaaaagcgcagaatgcctttttctattgtgagtcttacgccgatagcatggcgcgcgcagatgatgcatccgtcgtctattgcgatccgccttatgcaccgctgtctgcgaccgccaactttacggcgtatcacacaaacagttttacgcttgaacaacaagcgcatctggcggagatcgccgaaggtctggttgagcgccatattccagtgctgatctccaatcacgatacgatgttaacgcgtgagtggtatcagcgcgcaaaattgcatgtcgtcaaagttcgacgcagtataagcagcaacggcggcacacgtaaaaaggtggacgaactgctggctttgtacaaaccaggagtcgtttcacccgcgaaaaaataattcagctaagacactgcactggattaagatgaaaacgattgaagttgatgatgaactctacagctatattgccagccacactaagcatatcggcgagagcgcatccgacattttacggcgtatgttgaaattttccgccgcatcacagcctgctgctccggtgacgaaagaggttcgcgttgcgtcacctgctatcgtcgaagcgaagccggtcaaaacgattaaagacaaggttcgcgcaatgcgtgaacttctgctttcggatgaatacgcagagcaaaagcgagcggtcaatcgctttatgctgctgttgtctacactatattctcttgacgcccaggcgtttgccgaagcaacggaatcgttgcacggtcgtacacgcgtttactttgcggcagatgaacaaacgctgctgaaaaatggtaatcagaccaagccgaaacatgtgccaggcacgccgtattgggtgatcaccaacaccaacaccggccgtaaatgcagcatgatcgaacacatcatgcagtcgatgcaattcccggcggaattgattgagaaggtttgcggaactatctaacggctgaaattaatgaggtcatacccaaatggatagttcgtttacgcccattgaacaaatgctaaaatttcgcgccagccgccacgaagattttccttatcaggagatccttctgactcgtctttgcatgcacatgcaaagcaagctgctggagaaccgcaataaaatgctgaaggctcagggaattaacgagacgttgtttatggcgttgattacgctggagtctcaggaaaaccacagtattcagccttctgaattaagttgtgctcttggatcatcccgtaccaacgcgacgcgtattgccgatgaactggaaaaacgcggttggatcgaacgtcgtgaaagcgataacgatcgccgctgcctgcatctgcaattaacggaaaaaggtcacgagtttttgcgcgaggttttaccaccgcagcataactgcctgcatcaactctggtccgcgctcagcacaacagaaaaagatcagctcgagcaaatcacccgcaaattgctctcccgtctcgaccagatggaacaagacggtgtggttctcgaagcgatgagctaataatacaaaaattaggaggaatttcaacatgacaaatttatctgacatcattgaaaaagaaacaggaaaacaactagtgattcaagaatcaattctaatgttaccagaagaagtagaggaagtaattgggaataaaccagaaagtgatattttagttcatactgcttatgatgaaagtacagatgaaaatgtaatgctattaacttcagatgctccagaatataaaccttgggctttagtaattcaagacagtaatggagaaaataaaattaaaatgttataagtcgagattaagtaaaccggaatctgaagatgaccgacgcggaatacgttcgtatccacgaaaaactggacatctacaccttcaaaaaacagttcttcaacaacaaaaaatctgtttctcaccgttgctacgttctgttcgaactgaaacgtcgtggtgaacgtcgtgcgtgcttctggggttacgcggttaacaaaccgcagtctggtaccgaacgtggtatccacgcggaaatcttctctatccgtaaagttgaagaatacctgcgtgacaacccgggtcagttcaccatcaactggtactcttcttggtctccgtgcgcggactgcgcggaaaaaatcctggaatggtacaaccaggaactgcgtggtaacggtcacaccctgaaaatctgggcgtgcaaactgtactacgaaaaaaacgcgcgtaaccagatcggtctgtggaacctgcgtgacaacggtgttggtctgaacgttatggtttctgaacactaccagtgctgccgtaaaatcttcatccagtcttctcacaaccagctgaacgaaaaccgttggctggaaaaaaccctgaaacgtgcggaaaaacgtcgttctgaactgtctatcatgatccaggttaaaatcctgcacaccaccaaatctccggcggtttaaacttaattaacggcactcctcagccaagtcaaaagcctccggtcggaggcttttgactacatgcccatggcgtttacgccccgccctgccactcatcgcagtactgttgtaattcattaagcattctgccgacatggaagccatcacaaacggcatgatgaacctgaatcgccagcggcatcagcaccttgtcgccttgcgtataatatttgcccatagtgaaaacgggggcgaagaagttgtccatattggccacgtttaaatcaaaactggtgaaactcacccagggattggctgagacgaaaaacatattctcaataaaccctttagggaaataggccaggttttcaccgtaacacgccacatcttgcgaatatatgtgtagaaactgccggaaatcgtcgtggtattcactccagagcgatgaaaacgtttcagtttgctcatggaaaacggtgtaacaagggtgaacactatcccatatcaccagctcaccgtctttcattgccatacggaactccggatgagcattcatcaggcgggcaagaatgtgaataaaggccggataaaacttgtgcttatttttctttacggtctttaaaaaggccgtaatatccagctgaacggtctggttataggtacattgagtaactgactgaaatgcctcaaaatgttctttacgatgccattgggatatatcaacggtggtatatccagtgatttttttctccattttagcttccttagctcctgaaaatctcgataactcaaaaaatacgcccggtagtgatcttatttcattatggtgaaagttggaacctcttacgtgccaagccaaataggccgt

SEQ ID NO: 27 - DNA, 8495 bp, Artificial Sequence
  Synthetic Polynucleotide
cactcggtcgctacgctccgggcgtgagactgcggcgggcgctgcggacacatacaaagttacccacagattccgtggataagcaggggactaacatgtgaggcaaaacagcagggccgcgccggtggcgtttttccataggctccgccctcctgccagagttcacataaacagacgcttttccggtgcatctgtgggagccgtgaggctcaaccatgaatctgacagtacgggcgaaacccgacaggacttaaagatccccaccgtttccggcgggtcgctccctcttgcgctctcctgttccgaccctgccgtttaccggatacctgttccgcctttctcccttacgggaagtgtggcgctttctcatagctcacacactggtatctcggctcggtgtaggtcgttcgctccaagctgggctgtaagcaagaactccccgttcagcccgactgctgcgccttatccggtaactgttcacttgagtccaacccggaaaagcacggtaaaacgccactggcagcagccattggtaactgggagttcgcagaggatttgtttagctaaacacgcggttgctcttgaagtgtgcgccaaagtccggctacactggaaggacagatttggttgctgtgctctgcgaaagccagttaccacggttaagcagttccccaactgacttaaccttcgatcaaaccacctccccaggtggttttttcgtttacagggcaaaagattacgcgcagaaaaaaaggatctcaagaagatcctttgatcttttctactgaaccgctctagatttcagtgcaatttatctcttcaaatgtagcacctgaagtcagcccaggaggaagaggacatccggtcaaataaaacgaaaggctcagtcgaaagactgggcctttcgttttgctgaggagacttagggaccctttaagactccttattacgcagtatgttagcaaacgtagaaaatacatacataaaggtggcaacatataaaagaaacgcaaagacaccgcggaacaggttgatcttatcgcagtcgatactgaactcgtaaggtttaccagcgccaaagacaaaagggcgacattcaaccgattgagggagggaaggtaaatattgacggaaattattcattaaaggtgaattatcaccgtcaccgacttgagccatttgggaattagagccagcaaaatcaccagtagcaccattaccattagcaaggccggaaacgtcaccaatgaaaccatcgatagcagcaccgtaatcagtagcgacagaatcaagtttgcctttagcgtcagactgtagcgcgttttcatcggcattttcggtcatagcccccttattagcgtttgccatcttttcataatcaaaatcaccggaaccagagccaccaccggaaccgcctccctcagagccgccaccctcagaaccgccaccctcagagccaccaccctcagagccgccaccagaaccaccaccagagccgccgccagcattgacaggaggttgaggcaggtcagacgattggccttgatattcacaaacgaatggatcctcattaaagccagaatggaaagcgcagtctctgaatttaccgttccagtaagcgtcatacatggcttttgatgatacaggagtgtactggtaataagttttaacggggtcagtgccttgagtaacagtgcccgtataaacagttaatgccccctgcctatttcggaacctattattctgaaacatgaaagtattaagaggctgagactcctcaagagaaggattaggattagcggggttttgctcagtaccaggcggataagtgccgtcgagagggttgatataagtatagcccggaataggtgtatcaccgtactcaggaggtttagtaccgccaccctcagaaccgccaccctcagaaccgccaccctcagagccaccaccctcattttcagggatagcaagcccaataggaacccatgtaccgtaacactgagtttcgtcaccagtacaaactacaacgcctgtagcattccacagacagccctcatagttagcgtaacgatctaaagttttgtcgtctttccagacgttagtaaatgaattttctgtatggggttttgctaaacaactttcaacagtttcagcggagtgagaatagaaaggaacaactaaaggaattgcgaataataattttttcattttttttttcctttactgcacctgcaggtaatgttgtcctcttgatttctgcgttcaggattgtcctgctctctatcactgatagggatgaactgttaatacaatttgcgtgccaattttttatctttttgatttataaagatctgattgaagaatcaacagcaacatgccaggatgagttagcgaattacactaacaagtggcgaatttcatcacggagccaatgtcctcagcgagtttgtagaaacgcaaaaaggccatccgtcaggatggccttctgcttaatttgatgcctggcagtttatggcgggcgtcctgcccgccaccctccgggccgttgcttcgcaacgttcaaatccgctcccggcggatttgtcctactcaggagagcgttcaccgacaaacaacagataaaacgaaaggcccagtctttcgactgagcctttcgttttatttgatgcctggcagttccctactctcgcatggggagaccccacactaccatcggcgctacggcgtttcacttctgagttcggcatggggtcaggtgggaccaccgcgctactgccgccaggcaaattctgttttatcagaccgcttctgcgttctgatttaatctgtatcaggctgaaaatcttctctcatccgccaaaacagccagggccctactgactgtttatgacaacttgacggctacatcattcactttttcttcacaaccggcacggaactcgctcgggctggccccggtgcattttttaaatacccgcgagaaatagagttgatcgtcaaaaccaacattgcgaccgacggtggcgataggcatccgggtggtgctcaaaagcagcttcgcctggctgatacgttggtcctcgcgccagcttaagacgctaatccctaactgctggcggaaaagatgtgacagacgcgacggcgacaagcaaacatgctgtgcgacgctggcgatatcaaaattgctgtctgccaggtgatcgctgatgtactgacaagcctcgcgtacccgattatccatcggtggatggagcgactcgttaatcgcttccatgcgccgcagtaacaattgctcaagcagatttatcgccagcagctccgaatagcgcccttccccttgcccggcgttaatgatttgcccaaacaggtcgctgaaatgcggctggtgcgcttcatccgggcgaaagaaccccgtattggcaaatattgacggccagttaagccattcatgccagtaggcgcgcggacgaaagtaaacccactggtgataccattcgcgagcctccggatgacgaccgtagtgatgaatctctcctggcgggaacagcaaaatatcacccggtcggcaaacaaattctcgtccctgatttttcaccaccccctgaccgcgaatggtgagattgagaatataacctttcattcccagcggtcggtcgataaaaaaatcgagataaccgttggcctcaatcggcgttaaacccgccaccagatgggcattaaacgagtatcccggcagcaggggatcattttgcgcttcagccatacttttcatactcccaccattcagagaagaaaccaattgtccatattgcatcagacattgccgtcactgcgtcttttactggctcttctcgctaacccaaccggtaaccccgcttattaaaagcattctgtaacaaagcgggaccaaagccatgacaaaaacgcgtaacaaaagtgtctataatcacggcagaaaagtccacattgattatttgcacggcgtcacactttgctatgccatagcatttttatccataagattagcggatcctacctgacgctttttatcgcaactctctactgtttctccatacccgtttttttggacgcgtacaactcaagtctgacataaatgaccgctatgagcactgcaattacacgccagatcgttctcgctaccgcaaccaccggtatgaaccagattggtgcgcactatgaaggccacaagatcattgagattggtgccgttgaagtggtgaaccgtcgcctgacgggcaataacttccatgtttatctcaaacccgatcggctggtggatccggaagcctttggcgtacatggtattgccgatgaatttttgctcgataagcccacgtttgccgaagtagccgatgagttcatggactatattcgcggcgcggagttggtgatccataacgcagcgttcgatatcggctttatggactacgagttttcgttgcttaagcgcgatattccgaagaccaatactttctgtaaggtcaccgatagccttgcggtggcgaggaaaatgtttcccggtaagcgcaacagcctcgatgcgttatgtgctcgctacgaaatagataacagtaaacgaacgctgcacggggcattactcgatgcccagatccttgcggaagtttatctggcgatgaccggtggtcaaacgtcgatggcttttgcgatggaaggagagacacaacagcaacaaggtgaagcaacaattcagcgcattgtacgtcaggcaagtaagttacgcgttgtttttgcgacagatgaagagattgcagctcatgaagcccgtctcgatctggtgcagaagaaaggcggaagttgcctctggcgagcataaaccggtatgcctcacacaggaaacagaattcattaccatgggctttccttcaccggcagcagattacgttgaacagcgcatcgatctgaatcaactgttgatccagcatcccagcgcgacttacttcgtcaaagcaagtggtgattctatgattgatggtggaattagtgacggtgatttactgattgtcgatagcgctattaccgccagccatggtgatattgtcatcgctgctgttgacggcgagtttacggtgaaaaaattgcaactacgcccgacggtacagcttattcccatgaacagcgcgtactcgcccattaccatcagtagtgaagatacgctggatgtctttggtgtggtgatccacgtcgttaaggcgatgcgctgatgtttgccctctgtgatgtaaacgcgttttatgccagctgtgagacggtgtttcgccctgatttatggggtaaaccggtggttgtgctatcgaataatgacggttgcgttatcgcccgaaacgctgaggcaaaggcgcttggcgttaaaatgggcgatccctggttcaaacaaaaagatctgtttcgtcgctgtggcgtggtttgctttagcagcaattatgagctttacgcagacatgagcaatcgggtgatgtcgacgctggaagagctatcgccccgcgtcgagatttacagtaccggtatgcctattgatgaggcattctgcgatctgacaggtgtgcgtaattgtcgcgatctgactgattttggcagagaaattcgcgcaacggtgctacaacgtacccatcttactgttggtgtggggatcgcccagaccaaaacgctggctaagcttgccaatcatgcggcaaaaaaatggcagcggcagacgggtggggtggtggatttatcaaatctggaacgccagcgtaaattaatgtctgctctccccgtggatgacgtctgggggattggacggcggatcagcaaaaaactggacgcgatggggatcaaaaccgttctcgatttggcggatacagatatccggtttatccgtaaacattttaatgtcgtgctcgaaagaacggtgcgtgaactgcgcggcgaaccctgtttgcaactggaagagtttgcaccgacgaagcaggaaattatctgttcccgctcgtttggtgaacgcatcacggattatccgtcgatgcggcaggccatttgtagttacgctgcccgggcggcggaaaaacttcgcagcgagcatcaatattgtcgattaatttccacgtttattaagacgtcaccatttgcgctcaatgaaccttattacggcaatagcgcgtcggtaaaactgctgacgcccactcaggacagcagggatatcattaacgctgctacgcgatctctggatgccatctggcaagcgggccatcgttaccaaaaagcgggcgtgatgctgggggatttcttcagtcagggagtcgcgcagctcaatttattcgatgacaacgcaccgcgccccgggagtgagcaattgatgacggtaatggatacactgaatgctaaagagggcagaggaacactctattttgccgggcaggggatccagcaacaatggcagatgaagcgagccatgctttcaccacgttatacaacgcgaagttctgatttactgagggtcaaataaatatagcggcaggaaaaaagcgatcccgcatatccggtattacccggcatgacaggagtaaaaatggctatcgacgaaaacaaacagaaagcgttggcggcagcactgggccagattgagaaacaatttggtaaaggctccatcatgcgcctgggtgaagaccgttccatggatgtgaaaaccatctctaccggttcgctttcactggatatcgcgcttggggcaggtggtctgccgatgggccgtatcgtcgaaatctacggaccggaatcttccggtaaaaccacgctgacgctgcaggtgatcgccgcagcgcagcgtgaaggtaaaacctgtgcgtttatcgatgctgaacacgcgctggacccaatctacgcacgtaaactgggcgtcgatatcgataacctgctgtgctcccagccggacaccggcgagcaggcactggaaatctgtgacgccctggcgcgttctggcgcagtagacgttatcgtcgttgactccgtggcggcactgacgccgaaagcggaaatcgaaggcgaaatcggcgactctcacatgggccttgcggcacgtatgatgagccaggcgatgcgtaagctggcgggtaacctgaagcagtccaacacgctgctgatcttcatcaaccagatccgtatgaaaattggtgtgatgttcggtaacccggaaaccactaccggtggtaacgcgctgaaattctacgcctctgttcgtctcgacatccgtcgtatcggcgcggtgaaagagggcgaaaacgtggtgggtagcgaaacccgcgtgaaagtggtgaagaacaaaatcgctgcgccgtttaaacaggctgaattccagatcctctacggcgaaggtatcaacttctacggcgaactggttgacctgggcgtaaaagagaagctgatcgagaaagcaggcgcgtggtacagctacaaaggtgagaagatcggtcagggtaaagcgaatgcgactgcctggctgaaagataacccggaaaccgcgaaagagatcgagaagaaagtacgtgagttgctgctgagcaacccgaactcaacgccggatttctctgtagatgatagcgaaggcgtagcagaaactaacgaagatttttaaacttaattaacggcactcctcagccaagtcaaaagcctccgaccggaggcttttgactacatgcccatggcgtttacgccccgccctgccactcatcgcagtactgttgtaattcattaagcattctgccgacatggaagccatcacaaacggcatgatgaacctgaatcgccagcggcatcagcaccttgtcgccttgcgtataatatttgcccatagtgaaaacgggggcgaagaagttgtccatattggccacgtttaaatcaaaactggtgaaactcacccagggattggctgagacgaaaaacatattctcaataaaccctttagggaaataggccaggttttcaccgtaacacgccacatcttgcgaatatatgtgtagaaactgccggaaatcgtcgtggtattcactccagagcgatgaaaacgtttcagtttgctcatggaaaacggtgtaacaagggtgaacactatcccatatcaccagctcaccgtctttcattgccatacggaactccggatgagcattcatcaggcgggcaagaatgtgaataaaggccggataaaacttgtgcttatttttctttacggtctttaaaaaggccgtaatatccagctgaacggtctggttataggtacattgagcaactgactgaaatgcctcaaaatgttctttacgatgccattgggatatatcaacggtggtatatccagtgatttttttctccattttagcttccttagctcctgaaaatctcgataactcaaaaaatacgcccggtagtgatcttatttcattatggtgaaagttggaacctcttacgtgccaagccaaataggccgt

SEQ ID NO: 28 - DNA, 5702 bp, Artificial Sequence
  Synthetic Polynucleotide
cactcggtcgctacgctccgggcgtgagactgcggcgggcgctgcggacacatacaaagttacccacagattccgtggataagcaggggactaacatgtgaggcaaaacagcagggccgcgccggtggcgtttttccataggctccgccctcctgccagagttcacataaacagacgcttttccggtgcatctgtgggagccgtgaggctcaaccatgaatctgacagtacgggcgaaacccgacaggacttaaagatccccaccgtttccggcgggtcgctccctcttgcgctctcctgttccgaccctgccgtttaccggatacctgttccgcctttctcccttacgggaagtgtggcgctttctcatagctcacacactggtatctcggctcggtgtaggtcgttcgctccaagctgggctgtaagcaagaactccccgttcagcccgactgctgcgccttatccggtaactgttcacttgagtccaacccggaaaagcacggtaaaacgccactggcagcagccattggtaactgggagttcgcagaggatttgtttagctaaacacgcggttgctcttgaagtgtgcgccaaagtccggctacactggaaggacagatttggttgctgtgctctgcgaaagccagttaccacggttaagcagttccccaactgacttaaccttcgatcaaaccacctccccaggtggttttttcgtttacagggcaaaagattacgcgcagaaaaaaaggatctcaagaagatcctttgatcttttctactgaaccgctctagatttcagtgcaatttatctcttcaaatgtagcacctgaagtcagcccaggaggaagaggacatccggtcaaataaaacgaaaggctcagtcgaaagactgggcctttcgttttgctgaggagacttagggaccctttaagactccttattacgcagtatgttagcaaacgtagaaaatacatacataaaggtggcaacatataaaagaaacgcaaagacaccgcggaacaggttgatcttatcgcagtcgatactgaactcgtaaggtttaccagcgccaaagacaaaagggcgacattcaaccgattgagggagggaaggtaaatattgacggaaattattcattaaaggtgaattatcaccgtcaccgacttgagccatttgggaattagagccagcaaaatcaccagtagcaccattaccattagcaaggccggaaacgtcaccaatgaaaccatcgatagcagcaccgtaatcagtagcgacagaatcaagtttgcctttagcgtcagactgtagcgcgttttcatcggcattttcggtcatagcccccttattagcgtttgccatcttttcataatcaaaatcaccggaaccagagccaccaccggaaccgcctccctcagagccgccaccctcagaaccgccaccctcagagccaccaccctcagagccgccaccagaaccaccaccagagccgccgccagcattgacaggaggttgaggcaggtcagacgattggccttgatattcacaaacgaatggatcctcattaaagccagaatggaaagcgcagtctctgaatttaccgttccagtaagcgtcatacatggcttttgatgatacaggagtgtactggtaataagttttaacggggtcagtgccttgagtaacagtgcccgtataaacagttaatgccccctgcctatttcggaacctattattctgaaacatgaaagtattaagaggctgagactcctcaagagaaggattaggattagcggggttttgctcagtaccaggcggataagtgccgtcgagagggttgatataagtatagcccggaataggtgtatcaccgtactcaggaggtttagtaccgccaccctcagaaccgccaccctcagaaccgccaccctcagagccaccaccctcattttcagggatagcaagcccaataggaacccatgtaccgtaacactgagtttcgtcaccagtacaaactacaacgcctgtagcattccacagacagccctcatagttagcgtaacgatctaaagttttgtcgtctttccagacgttagtaaatgaattttctgtatggggttttgctaaacaactttcaacagtttcagcggagtgagaatagaaaggaacaactaaaggaattgcgaataataattttttcattttttttttcctttactgcacctgcaggtaatgttgtcctcttgatttctgcgttcaggattgtcctgctctctatcactgatagggatgaactgttaatacaatttgcgtgccaattttttatctttttgatttataaagatctgattgaagaatcaacagcaacatgccaggatgagttagcgaattacactaacaagtggcgaatttcatcacggagccaatgtcctcagcgagtttgtagaaacgcaaaaaggccatccgtcaggatggccttctgcttaatttgatgcctggcagtttatggcgggcgtcctgcccgccaccctccgggccgttgcttcgcaacgttcaaatccgctcccggcggatttgtcctactcaggagagcgttcaccgacaaacaacagataaaacgaaaggcccagtctttcgactgagcctttcgttttatttgatgcctggcagttccctactctcgcatggggagaccccacactaccatcggcgctacggcgtttcacttctgagttcggcatggggtcaggtgggaccaccgcgctactgccgccaggcaaattctgttttatcagaccgcttctgcgttctgatttaatctgtatcaggctgaaaatcttctctcatccgccaaaacagccagggccctactgactgtttatgacaacttgacggctacatcattcactttttcttcacaaccggcacggaactcgctcgggctggccccggtgcattttttaaatacccgcgagaaatagagttgatcgtcaaaaccaacattgcgaccgacggtggcgataggcatccgggtggtgctcaaaagcagcttcgcctggctgatacgttggtcctcgcgccagcttaagacgctaatccctaactgctggcggaaaagatgtgacagacgcgacggcgacaagcaaacatgctgtgcgacgctggcgatatcaaaattgctgtctgccaggtgatcgctgatgtactgacaagcctcgcgtacccgattatccatcggtggatggagcgactcgttaatcgcttccatgcgccgcagtaacaattgctcaagcagatttatcgccagcagctccgaatagcgcccttccccttgcccggcgttaatgatttgcccaaacaggtcgctgaaatgcggctggtgcgcttcatccgggcgaaagaaccccgtattggcaaatattgacggccagttaagccattcatgccagtaggcgcgcggacgaaagtaaacccactggtgataccattcgcgagcctccggatgacgaccgtagtgatgaatctctcctggcgggaacagcaaaatatcacccggtcggcaaacaaattctcgtccctgatttttcaccaccccctgaccgcgaatggtgagattgagaatataacctttcattcccagcggtcggtcgataaaaaaatcgagataaccgttggcctcaatcggcgttaaacccgccaccagatgggcattaaacgagtatcccggcagcaggggatcattttgcgcttcagccatacttttcatactcccaccattcagagaagaaaccaattgtccatattgcatcagacattgccgtcactgcgtcttttactggctcttctcgctaacccaaccggtaaccccgcttattaaaagcattctgtaacaaagcgggaccaaagccatgacaaaaacgcgtaacaaaagtgtctataatcacggcagaaaagtccacattgattatttgcacggcgtcacactttgctatgccatagcatttttatccataagattagcggatcctacctgacgctttttatcgcaactctctactgtttctccatacccgtttttttggacgcgtacaactcaagtctgacataaatgaccgctatgagcactgcaattacacgccagatcgttctcgctaccgcaaccaccggtatgaaccagattggtgcgcactatgaaggccacaagatcattgagattggtgccgttgaagtggtgaaccgtcgcctgacgggcaataacttccatgtttatctcaaacccgatcggctggtggatccggaagcctttggcgtacatggtattgccgatgaatttttgctcgataagcccacgtttgccgaagtagccgatgagttcatggactatattcgcggcgcggagttggtgatccataacgcagcgttcgatatcggctttatggactacgagttttcgttgcttaagcgcgatattccgaagaccaatactttctgtaaggtcaccgatagccttgcggtggcgaggaaaatgtttcccggtaagcgcaacagcctcgatgcgttatgtgctcgctacgaaatagataacagtaaacgaacgctgcacggggcattactcgatgcccagatccttgcggaagtttatctggcgatgaccggtggtcaaacgtcgatggcttttgcgatggaaggagagacacaacagcaacaaggtgaagcaacaattcagcgcattgtacgtcaggcaagtaagttacgcgttgtttttgcgacagatgaagagattgcagctcatgaagcccgtctcgatctggtgcagaagaaaggcggaagttgcctctggcgagcataaacttaattaacggcactcctcagccaagtcaaaagcctccgaccggaggcttttgactacatgcccatggcgtttacgccccgccctgccactcatcgcagtactgttgtaattcattaagcattctgccgacatggaagccatcacaaacggcatgatgaacctgaatcgccagcggcatcagcaccttgtcgccttgcgtataatatttgcccatagtgaaaacgggggcgaagaagttgtccatattggccacgtttaaatcaaaactggtgaaactcacccagggattggctgagacgaaaaacatattctcaataaaccctttagggaaataggccaggttttcaccgtaacacgccacatcttgcgaatatatgtgtagaaactgccggaaatcgtcgtggtattcactccagagcgatgaaaacgtttcagtttgctcatggaaaacggtgtaacaagggtgaacactatcccatatcaccagctcaccgtctttcattgccatacggaactccggatgagcattcatcaggcgggcaagaatgtgaataaaggccggataaaacttgtgcttatttttctttacggtctttaaaaaggccgtaatatccagctgaacggtctggttataggtacattgagcaactgactgaaatgcctcaaaatgttctttacgatgccattgggatatatcaacggtggtatatccagtgatttttttctccattttagcttccttagctcctgaaaatctcgataactcaaaaaatacgcccggtagtgatcttatttcattatggtgaaagttggaacctcttacgtgccaagccaaataggccgt

SEQ ID NO: 29 - DNA, 6567 bp, Artificial Sequence
  Synthetic Polynucleotide
cactcggtcgctacgctccgggcgtgagactgcggcgggcgctgcggacacatacaaagttacccacagattccgtggataagcaggggactaacatgtgaggcaaaacagcagggccgcgccggtggcgtttttccataggctccgccctcctgccagagttcacataaacagacgcttttccggtgcatctgtgggagccgtgaggctcaaccatgaatctgacagtacgggcgaaacccgacaggacttaaagatccccaccgtttccggcgggtcgctccctcttgcgctctcctgttccgaccctgccgtttaccggatacctgttccgcctttctcccttacgggaagtgtggcgctttctcatagctcacacactggtatctcggctcggtgtaggtcgttcgctccaagctgggctgtaagcaagaactccccgttcagcccgactgctgcgccttatccggtaactgttcacttgagtccaacccggaaaagcacggtaaaacgccactggcagcagccattggtaactgggagttcgcagaggatttgtttagctaaacacgcggttgctcttgaagtgtgcgccaaagtccggctacactggaaggacagatttggttgctgtgctctgcgaaagccagttaccacggttaagcagttccccaactgacttaaccttcgatcaaaccacctccccaggtggttttttcgtttacagggcaaaagattacgcgcagaaaaaaaggatctcaagaagatcctttgatcttttctactgaaccgctctagatttcagtgcaatttatctcttcaaatgtagcacctgaagtcagcccaggaggaagaggacatccggtcaaataaaacgaaaggctcagtcgaaagactgggcctttcgttttgctgaggagacttagggaccctttaagactccttattacgcagtatgttagcaaacgtagaaaatacatacataaaggtggcaacatataaaagaaacgcaaagacaccgcggaacaggttgatcttatcgcagtcgatactgaactcgtaaggtttaccagcgccaaagacaaaagggcgacattcaaccgattgagggagggaaggtaaatattgacggaaattattcattaaaggtgaattatcaccgtcaccgacttgagccatttgggaattagagccagcaaaatcaccagtagcaccattaccattagcaaggccggaaacgtcaccaatgaaaccatcgatagcagcaccgtaatcagtagcgacagaatcaagtttgcctttagcgtcagactgtagcgcgttttcatcggcattttcggtcatagcccccttattagcgtttgccatcttttcataatcaaaatcaccggaaccagagccaccaccggaaccgcctccctcagagccgccaccctcagaaccgccaccctcagagccaccaccctcagagccgccaccagaaccaccaccagagccgccgccagcattgacaggaggttgaggcaggtcagacgattggccttgatattcacaaacgaatggatcctcattaaagccagaatggaaagcgcagtctctgaatttaccgttccagtaagcgtcatacatggcttttgatgatacaggagtgtactggtaataagttttaacggggtcagtgccttgagtaacagtgcccgtataaacagttaatgccccctgcctatttcggaacctattattctgaaacatgaaagtattaagaggctgagactcctcaagagaaggattaggattagcggggttttgctcagtaccaggcggataagtgccgtcgagagggttgatataagtatagcccggaataggtgtatcaccgtactcaggaggtttagtaccgccaccctcagaaccgccaccctcagaaccgccaccctcagagccaccaccctcattttcagggatagcaagcccaataggaacccatgtaccgtaacactgagtttcgtcaccagtacaaactacaacgcctgtagcattccacagacagccctcatagttagcgtaacgatctaaagttttgtcgtctttccagacgttagtaaatgaattttctgtatggggttttgctaaacaactttcaacagtttcagcggagtgagaatagaaaggaacaactaaaggaattgcgaataataattttttcattttttttttcctttactgcacctgcaggtaatgttgtcctcttgatttctgcgttcaggattgtcctgctctctatcactgatagggatgaactgttaatacaatttgcgtgccaattttttatctttttgatttataaagatctgattgaagaatcaacagcaacatgccaggatgagttagcgaattacactaacaagtggcgaatttcatcacggagccaatgtcctcagcgagtttgtagaaacgcaaaaaggccatccgtcaggatggccttctgcttaatttgatgcctggcagtttatggcgggcgtcctgcccgccaccctccgggccgttgcttcgcaacgttcaaatccgctcccggcggatttgtcctactcaggagagcgttcaccgacaaacaacagataaaacgaaaggcccagtctttcgactgagcctttcgttttatttgatgcctggcagttccctactctcgcatggggagaccccacactaccatcggcgctacggcgtttcacttctgagttcggcatggggtcaggtgggaccaccgcgctactgccgccaggcaaattctgttttatcagaccgcttctgcgttctgatttaatctgtatcaggctgaaaatcttctctcatccgccaaaacagccagggccctactgactgtttatgacaacttgacggctacatcattcactttttcttcacaaccggcacggaactcgctcgggctggccccggtgcattttttaaatacccgcgagaaatagagttgatcgtcaaaaccaacattgcgaccgacggtggcgataggcatccgggtggtgctcaaaagcagcttcgcctggctgatacgttggtcctcgcgccagcttaagacgctaatccctaactgctggcggaaaagatgtgacagacgcgacggcgacaagcaaacatgctgtgcgacgctggcgatatcaaaattgctgtctgccaggtgatcgctgatgtactgacaagcctcgcgtacccgattatccatcggtggatggagcgactcgttaatcgcttccatgcgccgcagtaacaattgctcaagcagatttatcgccagcagctccgaatagcgcccttccccttgcccggcgttaatgatttgcccaaacaggtcgctgaaatgcggctggtgcgcttcatccgggcgaaagaaccccgtattggcaaatattgacggccagttaagccattcatgccagtaggcgcgcggacgaaagtaaacccactggtgataccattcgcgagcctccggatgacgaccgtagtgatgaatctctcctggcgggaacagcaaaatatcacccggtcggcaaacaaattctcgtccctgatttttcaccaccccctgaccgcgaatggtgagattgagaatataacctttcattcccagcggtcggtcgataaaaaaatcgagataaccgttggcctcaatcggcgttaaacccgccaccagatgggcattaaacgagtatcccggcagcaggggatcattttgcgcttcagccatacttttcatactcccaccattcagagaagaaaccaattgtccatattgcatcagacattgccgtcactgcgtcttttactggctcttctcgctaacccaaccggtaaccccgcttattaaaagcattctgtaacaaagcgggaccaaagccatgacaaaaacgcgtaacaaaagtgtctataatcacggcagaaaagtccacattgattatttgcacggcgtcacactttgctatgccatagcatttttatccataagattagcggatcctacctgacgctttttatcgcaactctctactgtttctccatacccgtttttttggacgcgtacaactcaagtctgacataaatgaccgctatgagcactgcaattacacgccagatcgttctcgctaccgcaaccaccggtatgaaccagattggtgcgcactatgaaggccacaagatcattgagattggtgccgttgaagtggtgaaccgtcgcctgacgggcaataacttccatgtttatctcaaacccgatcggctggtggatccggaagcctttggcgtacatggtattgccgatgaatttttgctcgataagcccacgtttgccgaagtagccgatgagttcatggactatattcgcggcgcggagttggtgatccataacgcagcgttcgatatcggctttatggactacgagttttcgttgcttaagcgcgatattccgaagaccaatactttctgtaaggtcaccgatagccttgcggtggcgaggaaaatgtttcccggtaagcgcaacagcctcgatgcgttatgtgctcgctacgaaatagataacagtaaacgaacgctgcacggggcattactcgatgcccagatccttgcggaagtttatctggcgatgaccggtggtcaaacgtcgatggcttttgcgatggaaggagagacacaacagcaacaaggtgaagcaacaattcagcgcattgtacgtcaggcaagtaagttacgcgttgtttttgcgacagatgaagagattgcagctcatgaagcccgtctcgatctggtgcagaagaaaggcggaagttgcctctggcgagcataatttaatatcagtaaaccggacataacccatgaagaaaaatcgcgcttttttgaagtgggcagggggcaagtatcccctgcttgatgatattaaacggcatttgcccaagggcgaatgtctggttgagccttttgtaggtgccgggtcggtgtttctcaacaccgacttttctcgttatatccttgccgatatcaatagcgacctgatcagtctctataacattgtgaagatgcgtactgatgagtacgtacaggccgcacgcgagctgtttgttcccgaaacaaattgcgccgaggtttactatcagttccgcgaagagttcaacaaaagccaggatccgttccgtcgggcggtactgtttttatatttgaaccgctacggttacaacggcctgtgtcgttacaatctgcgcggtgagtttaacgtgccgttcggccgctacaaaaaaccctatttcccggaagcagagttgtatcacttcgctgaaaaagcgcagaatgcctttttctattgtgagtcttacgccgatagcatggcgcgcgcagatgatgcatccgtcgtctattgcgatccgccttatgcaccgctgtctgcgaccgccaactttacggcgtatcacacaaacagttttacgcttgaacaacaagcgcatctggcggagatcgccgaaggtctggttgagcgccatattccagtgctgatctccaatcacgatacgatgttaacgcgtgagtggtatcagcgcgcaaaattgcatgtcgtcaaagttcgacgcagtataagcagcaacggcggcacacgtaaaaaggtggacgaactgctggctttgtacaaaccaggagtcgtttcacccgcgaaaaaataaacttaattaacggcactcctcagccaagtcaaaagcctccgaccggaggcttttgactacatgcccatggcgtttacgccccgccctgccactcatcgcagtactgttgtaattcattaagcattctgccgacatggaagccatcacaaacggcatgatgaacctgaatcgccagcggcatcagcaccttgtcgccttgcgtataatatttgcccatagtgaaaacgggggcgaagaagttgtccatattggccacgtttaaatcaaaactggtgaaactcacccagggattggctgagacgaaaaacatattctcaataaaccctttagggaaataggccaggttttcaccgtaacacgccacatcttgcgaatatatgtgtagaaactgccggaaatcgtcgtggtattcactccagagcgatgaaaacgtttcagtttgctcatggaaaacggtgtaacaagggtgaacactatcccatatcaccagctcaccgtctttcattgccatacggaactccggatgagcattcatcaggcgggcaagaatgtgaataaaggccggataaaacttgtgcttatttttctttacggtctttaaaaaggccgtaatatccagctgaacggtctggttataggtacattgagcaactgactgaaatgcctcaaaatgttctttacgatgccattgggatatatcaacggtggtatatccagtgatttttttctccattttagcttccttagctcctgaaaatctcgataactcaaaaaatacgcccggtagtgatcttatttcattatggtgaaagttggaacctcttacgtgccaagccaaataggccgt

SEQ ID NO: 30 - DNA, 5389 bp, Artificial Sequence
  Synthetic Polynucleotide
atgattgacatgctagttttacgattaccgttcatcgattctcttgtttgctccagactctcaggcaatgacctgatagcctttgtagacctctcaaaaatagctaccctctccggcatgaatttatcagctagaacggttgaatatcatgttgatggtgatttgactgtctccggcctttctcacccttttgaatctttacctacacattactcaggcattgcatttaaaatatatgagggttctaaaaatttttatccttgcgttgaaataaaggcttctcccgcaaaagtattacagggtcataatgtttttggtacaaccgatttagctttatgctctgaggctttattgcttaattttgctaattctttgccttgcctgtatgatttattggatgttaacgctactactattagtagaattgatgccaccttttcagctcgcgccccaaatgaaaatatagctaaacaggttattgaccatttgcgaaatgtatctaatggtcaaactaaatctactcgttcgcagaattgggaatcaactgttacatggaatgaaacttccagacaccgtactttagttgcatatttaaaacatgttgagctacagcaccagattcagcaattaagctctaagccatccgcaaaaatgacctcttatcaaaaggagcaattaaaggtactctctaatcctgacctgttggagtttgcttccgggctggttcgctttgaagctcgaattagaacgcgatatttgaagtctttcgggcttcctcttaatctttttgatgcaatccgctttgcttctgactataatagtcagggtaaagacctgatttttgatttatggtcattctcgttttctgaactgtttaaagcatttgagggggattcaatgaatatttatgacgattccgcagtattggacgctatccagtctaaacattttactattaccccctctggcaaaacttcttttgcaaaagcctctcgctattttggtttttatcgtcgtctggtaaacgagggttatgatagtgttgctcttactatgcctcgtaattccttttggcgttatgtatctgcattagttgaatgtggtattcctaaatctcaactgatgaatctttctacctgtaataatgttgttccgttagttcgttttattaacgtagatttttcttcccaacgtcctgactggtataatgagccagttcttaaaatcgcataaggtaattcacaatgattaaagttgaaattaaaccatctcaagcccaatttactactcgttctggtgtttctcgtcagggcaagccttattcactgaatgagcagctttgttacgttgatttgggtaatgaatatccggttcttgtcaagattactcttgatgaaggtcagccagcctatgcgcctggtctgtacaccgttcatctgtcctctttcaaagttggtcagttcggttcccttatgattgaccgtctgcgcctcgttccggctaagtaacatggagcaggtcgcggatttcgacacaatttatcaggcgatgatacaaatctccgttgtactttgtttcgcgcttggtataatcgctgggggtcaaagatgagtgttttagtgtattctttcgcctctttcgttttaggttggtgccttcgtagtggcattacgtattttacccgtttaatggaaacttcctcatgaaaaagtctttagtcctcaaagcctctgtagccgttgctaccctcgttccgatgctgtctttcgctgctgagggtgacgatcccgcaaaagcggcctttaactccctgcaagcctcagcgaccgaatatatcggttatgcgtgggcgatggttgttgtcattgtcggcgcaactatcggtatcaagctgtttaagaaattcacctcgaaagcaagctgataaaccgatacaattaaaggctccttttggagccttttttttcgcgccagaaggagaccaagcttgcatgcctgcaggtcgactctagaggatccccgggtaccgagctcgaattctggagattttcaacatgctccctcaatcggttgaatgtcgcccttttgtctttagcgctggtaaaccatatgaattttctattgattgtgacaaaatgaacttattccgtggtgtctttgcgtttcttttatatgttgccacctttatgtatgtattttctacgtttgctaacatactgcgtaataaggagtcttaatcatgccagttcttttgggtattccgttattattgcgtttcctcggtttccttctggtaactttgttcggctatctgcttacttttcttaaaaagggcttcggtaagatagctattgctatttcattgtttcttgctcttattattgggcttaactcaattcttgtgggttatctctctgatattagcgctcaattaccctctgactttgttcagggtgttcagttaattctcccgtctaatgcgcttccctgtttttatgttattctctctgtaaaggctgctattttcatttttgacgttaaacaaaaaatcgtttcttatttggattgggataaataatatggctgtttattttgtaactggcaaattaggctctggaaagacgctcgttagcgttggtaagattcaggataaaattgtagctgggtgcaaaatagcaactaatcttgatttaaggcttcaaaacctcccgcaagtcgggaggttcgctaaaacgcctcgcgttcttagaataccggataagccttctatatctgatttgcttgctattgggcgcggtaatgattcctacgatgaaaataaaaacggcttgcttgttctcgatgagtgcggtacttggtttaatacccgttcttggaatgataaggaaagacagccgattattgattggtttctacatgctcgtaaattaggatgggatattatttttcttgttcaggacttatctattgttgataaacaggcgcgttctgcattagctgaacatgttgtttattgtcgtcgtctggacagaattactttaccttttgtcggtactttatattctcttattactggctcgaaaatgcctctgcctaaattacatgttggcgttgttaaatatggcgattctcaattaagccctactgttgagcgttggctttatactggtaagaatttgtataacgcatatgatactaaacaggctttttctagtaattatgattccggtgtttattcttatttaacgccttatttatcacacggtcggtatttcaaaccattaaatttaggtcagaagatgaaattaactaaaatatatttgaaaaagttttctcgcgttctttgtcttgcgattggatttgcatcagcatttacatatagttatataacccaacctaagccggaggttaaaaaggtagtctctcagacctatgattttgataaattcactattgactcttctcagcgtcttaatctaagctatcgctatgttttcaaggattctaagggaaaattaattaatagcgacgatttacagaagcaaggttattcactcacatatattgatttatgtactgtttccattaaaaaaggtaattcaaatgaaattgttaaatgtaattaattttgttttcttgatgtttgtttcatcatcttcttttgctcaggtaattgaaatgaataattcgcctctgcgcgattttgtaacttggtattcaaagcaatcaggcgaatccgttattgtttctcccgatgtaaaaggtactgttactgtatattcatctgacgttaaacctgaaaatctacgcaatttctttatttctgttttacgtgcaagtaattttgatatggttggttctaacccttccattattcagaagtataatccaaacaatcaggattatattgatgaattgccatcatctgataatcaggaatatgatgataattccgctccttctggtggtttctttgttccgcaaaatgataatgttactcaaacttttaaaattaataacgttcgggcaaaggatttaatacgagttgtcgaattgtttgtaaagtctaatacttctaaatcctcaaatgtattatctattgacggctctaatctattagttgttagtgcacctaaagatattttagataaccttcctcaattcctttctactgttgatttgccaactgaccagatattgattgagggtttgatatttgaggttcagcaaggtgatgctttagatttttcatttgctgctggctctcagcgtggcactgttgcaggcggtgttaatactgaccgcctcacctctgttttatcttctgctggtggttcgttcggtatttttaatggcgatgttttagggctatcagttcgcgcattaaagactaatagccattcaaaaatattgtctgtgccacgtattcttacgctttcaggtcagaagggttctatctttgttggccagaatgtcccttttattactggtcgtgtgactggtgaatctgccaatgtaaataatccatttcagacgattgagcgtcaaaatgtaggtatttccatgagcgtttttcctgttgcaatggctggcggtaatattgttctggatattaccagcaaggccgatagtttgagttcttctactcaggcaagtgatgttattactaatcaaagaagtactgctacaacggttaatttgcgtgatggacagactcttttactcggtggcctcactgattataaaaacacttctcaggattctggcgtaccgttcctgtctaaaatccctttaatcggcctcctgtttagctcccgctctgattctaacgaggaaagcacgttatacgtgctcgtcaaagcaaccatagtacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgatttgggtgatggttcacgtagtgggccatcgccctgatagacggtttttcgccctttgacgttggagtccacgttctttaatagtggactcttgttccaaactggaacaacactcaaccctatctcgggctattcttttgatttataagggattttgccgatttcggcctattggttaaaaaatgagctgatttaacaaaaatttaacgcgaattttaacaaaatattaacgtttacaatttaaatatttgcttatacaatcttcctgtttttggggcttttcttattatcaaccggggtacat

SEQ ID NO: 31 - DNA, 4630 bp, Artificial Sequence
  Synthetic Polynucleotide
ggctgttttggcggatgagagaagattttcagcctgatacagattaaatcagaacgcagaagcggtctgataaaacagaatttgcctggcggcagtagcgcggtggtcccacctgaccccatgccgaactcagaagtgaaacgccgtagcgccgatggtagtgtggggtctccccatgcgagagtagggaactgccaggcatcaaataaaacgaaaggctcagtcgaaagactgggcctttcgttttatctgttgtttgtcggtgaacgctctcctgagtaggacaaatccgccgggagcggatttgaacgttgcgaagcaacggcccggagggtggcgggcaggacgcccgccataaactgccaggcatcaaattaagcagaaggccatcctgacggatggcctttttgcgtttctacaaactctactctgctagcaagtaaggccgacaagcttgcatgcctgcaggtcgactctagaggatccccgggtaccgagctcgaattccctttttttttggagattttcaacgtgaaaaaattattattcgcaattcctttagttgttcctttctattctcactccgctgaaactgttgaaagttgtttagcaaaaccccatacagaaaattcatttactaacgtctggaaagacgacaaaactttagatcgttacgctaactatgagggctgtctgtggaatgctacaggcgttgtagtttgtactggtgacgaaactcagtgttacggtacatgggttcctattgggcttgctatccctgaaaatgagggtggtggctctgagggtggcggttctgagggtggcggttctgagggtggcggtactaaacctcctgagtacggtgatacacctattccgggctatacttatatcaaccctctcgacggcacttatccgcctggtactgagcaaaaccccgctaatcctaatccttctcttgaggagtctcagcctcttaatactttcatgtttcagaataataggttccgaaataggcagggggcattaactgtttatacgggcactgttactcaaggcactgaccccgttaaaacttattaccagtacactcctgtatcatcaaaagccatgtatgacgcttactggaacggtaaattcagagactgcgctttccattctggctttaatgaggatccattcgtttgtgaatatcaaggccaatcgtctgacctgcctcaacctcctgtcaatgctggcggcggctctggtggtggttctggtggcggctctgagggtggtggctctgagggtggcggttctgagggtggcggctctgagggaggcggttccggtggtggctctggttccggtgattttgattatgaaaagatggcaaacgctaataagggggctatgaccgaaaatgccgatgaaaacgcgctacagtctgacgctaaaggcaaacttgattctgtcgctactgattacggtgctgctatcgatggtttcattggtgacgtttccggccttgctaatggtaatggtgctactggtgattttgctggctctaattcccaaatggctcaagtcggtgacggtgataattcacctttaatgaataatttccgtcaatatttaccttccctccctcaatcggttgaatgtcgcccttttgtctttggcgctggtaaaccatatgaattttctattgattgtgacaaaataaacttattccgtggtgtctttgcgtttcttttatatgttgccacctttatgtatgtattttctacgtttgctaacatactgcgtaataaggagtcttaatcatgccagttctagcataaccccttggggcctctaaacgggtcttgaggggttttttgccttgtcggccttacttgctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattgatagactggatggaggcggataaagttgcaggaccacttctgcgctcggcccttccggctggctggtttattgctgataaatctggagccggtgagcgtggctctcgcggtatcattgcagcactggggccagatggtaagccctcccgtatcgtagttatctacacgacggggagtcaggcaactatggatgaacgaaatagacagatcgctgagataggtgcctcactgattaagcattggtaagaacctcagatccttccgtgatggtaacttcactagtttaaaaggatctaggtgaagatcctttttgataatctcatgaccaaaatcccttaacgtgagttttcgttccactgagcgtcagagaacctcagatccttccgtatttagccagtatgttctctagtgtggttcgttgtttttgcgtgagccatgagaacgaaccattgagatcatgcttactttgcatgtcactcaaaaattttgcctcaaaactggtgagctgaatttttgcagttaaagcatcgtgtagtgtttttcttagtccgttacgtaggtaggaatctgatgtaatggttgttggtattttgtcaccattcatttttatctggttgttctcaagttcggttacgagatccatttgtctatctagttcaacttggaaaatcaacgtatcagtcgggcggcctcgcttatcaaccaccaatttcatattgctgtaagtgtttaaatctttacttattggtttcaaaacccattggttaagccttttaaactcatggtagttattttcaagcattaacatgaacttaaattcatcaaggctaatctctatatttgccttgtgagttttcttttgtgttagttcttttaataaccactcataaatcctcatagagtatttgttttcaaaagacttaacatgttccagattatattttatgaatttttttaactggaaaagataaggcaatatctcttcactaaaaactaattctaatttttcgcttgagaacttggcatagtttgtccactggaaaatctcaaagcctttaaccaaaggattcctgatttccacagttctcgtcatcagctctctggttgctttagctaatacaccataagcattttccctactgatgttcatcatctgagcgtattggttataagtgaacgataccgtccgttctttccttgtagggttttcaatcgtggggttgagtagtgccacacagcataaaattagcttggtttcatgctccgttaagtcatagcgactaatcgctagttcatttgctttgaaaacaactaattcagacatacatctcaattggtctaggtgattttaatcactataccaattgagatgggctagtcaatgataattactagtccttttcctttgagttgtgggtatctgtaaattctgctagacctttgctggaaaacttgtaaattctgctagaccctctgtaaattccgctagacctttgtgtgttttttttgtttatattcaagtggttataatttatagaataaagaaagaataaaaaaagataaaaagaatagatcccagccctgtgtataactcactactttagtcagttccgcagtattacaaaaggatgtcgcaaacgctgtttgctcctctacaaaacagaccttaaaaccctaaaggcttaagtagcaccctcgcaagctcgggcaaatcgctgaatattccttttgtctccgaccatcaggcacctgagtcgctgtctttttcgtgacattcagttcgctgcgctcacggctctggcagtgaatgggggtaaatggcactacaggcgccttttatggattcatgcaaggaaactacccataatacaagaaaagcccgtcacgggcttctcagggcgttttatggcgggtctgctatgtggtgctatctgactttttgctgttcagcagttcctgccctctgattttccagtctgaccacttcggattatcccgtgacaggtcattcagactggctaatgcacccagtaaggcagcggtatcatcaact

SEQ ID NO: 32 - DNA, 4630 bp, Artificial Sequence; identical to SEQ ID NO: 31
  Synthetic Polynucleotide

SEQ ID NO: 33 - DNA, 7141 bp, Artificial Sequence
  Synthetic Polynucleotide
cactcggtcgctacgctccgggcgtgagactgcggcgggcgctgcggacacatacaaagttacccacagattccgtggataagcaggggactaacatgtgaggcaaaacagcagggccgcgccggtggcgtttttccataggctccgccctcctgccagagttcacataaacagacgcttttccggtgcatctgtgggagccgtgaggctcaaccatgaatctgacagtacgggcgaaacccgacaggacttaaagatccccaccgtttccggcgggtcgctccctcttgcgctctcctgttccgaccctgccgtttaccggatacctgttccgcctttctcccttacgggaagtgtggcgctttctcatagctcacacactggtatctcggctcggtgtaggtcgttcgctccaagctgggctgtaagcaagaactccccgttcagcccgactgctgcgccttatccggtaactgttcacttgagtccaacccggaaaagcacggtaaaacgccactggcagcagccattggtaactgggagttcgcagaggatttgtttagctaaacacgcggttgctcttgaagtgtgcgccaaagtccggctacactggaaggacagatttggttgctgtgctctgcgaaagccagttaccacggttaagcagttccccaactgacttaaccttcgatcaaaccacctccccaggtggttttttcgtttacagggcaaaagattacgcgcagaaaaaaaggatctcaagaagatcctttgatcttttctactgaaccgctctagatttcagtgcaatttatctcttcaaatgtagcacctgaagtcagcccaggaggaagaggacatccggtcaaataaaacgaaaggctcagtcgaaagactgggcctttcgttttgctgaggagacttagggaccctttaagactccttattacgcagtatgttagcaaacgtagaaaatacatacataaaggtggcaacatataaaagaaacgcaaagacaccgcggaacaggttgatcttatcgcagtcgatactgaactcgtaaggtttaccagcgccaaagacaaaagggcgacattcaaccgattgagggagggaaggtaaatattgacggaaattattcattaaaggtgaattatcaccgtcaccgacttgagccatttgggaattagagccagcaaaatcaccagtagcaccattaccattagcaaggccggaaacgtcaccaatgaaaccatcgatagcagcaccgtaatcagtagcgacagaatcaagtttgcctttagcgtcagactgtagcgcgttttcatcggcattttcggtcatagcccccttattagcgtttgccatcttttcataatcaaaatcaccggaaccagagccaccaccggaaccgcctccctcagagccgccaccctcagaaccgccaccctcagagccaccaccctcagagccgccaccagaaccaccaccagagccgccgccagcattgacaggaggttgaggcaggtcagacgattggccttgatattcacaaacgaatggatcctcattaaagccagaatggaaagcgcagtctctgaatttaccgttccagtaagcgtcatacatggcttttgatgatacaggagtgtactggtaataagttttaacggggtcagtgccttgagtaacagtgcccgtataaacagttaatgccccctgcctatttcggaacctattattctgaaacatgaaagtattaagaggctgagactcctcaagagaaggattaggattagcggggttttgctcagtaccaggcggataagtgccgtcgagagggttgatataagtatagccaggaataggtgtatcaccgtactcaggaggtttagtaccgccaccctcagaaccgccaccctcagaaccgccaccctcagagccaccaccctcattttcagggatagcaagcccaataggaacccatgtaccgtaacactgagtttcgtcaccagtacaaactacaacgcctgtagcattccacagacagccctcatagttagcgtaacgatctaaagttttgtcgtctttccagacgttagtaaatgaattttctgtatggggttttgctaaacaactttcaacagtttcagcggagtgagaatagaaaggaacaactaaaggaattgcgaataataattttttcattttttttttcctttactgcacctgcaggtaatgttgtcctcttgatttctgcgttcaggattgtcctgctctctatcactgatagggatgaactgttaatacaatttgcgtgccaattttttatctttttgatttataaagatctgattgaagaatcaacagcaacatgccaggatgagttagcgaattacactaacaagtggcgaatttcatcacggagccaatgtcctcagcgagtttgtagaaacgcaaaaaggccatccgtcaggatggccttctgcttaatttgatgcctggcagtttatggcgggcgtcctgcccgccaccctccgggccgttgcttcgcaacgttcaaatccgctcccggcggatttgtcctactcaggagagcgttcaccgacaaacaacagataaaacgaaaggcccagtctttcgactgagcctttcgttttatttgatgcctggcagttccctactctcgcatggggagaccccacactaccatcggcgctacggcgtttcacttctgagttcggcatggggtcaggtgggaccaccgcgctactgccgccaggcaaattctgttttatcagaccgcttctgcgttctgatttaatctgtatcaggctgaaaatcttctctcatccgccaaaacagccagggccctactgactgtttatgacaacttgacggctacatcattcactttttcttcacaaccggcacggaactcgctcgggctggccccggtgcattttttaaatacccgcgagaaatagagttgatcgtcaaaaccaacattgcgaccgacggtggcgataggcatccgggtggtgctcaaaagcagcttcgcctggctgatacgttggtcctcgcgccagcttaagacgctaatccctaactgctggcggaaaagatgtgacagacgcgacggcgacaagcaaacatgctgtgcgacgctggcgatatcaaaattgctgtctgccaggtgatcgctgatgtactgacaagcctcgcgtacccgattatccatcggtggatggagcgactcgttaatcgcttccatgcgccgcagtaacaattgctcaagcagatttatcgccagcagctccgaatagcgcccttccccttgcccggcgttaatgatttgcccaaacaggtcgctgaaatgcggctggtgcgcttcatccgggcgaaagaaccccgtattggcaaatattgacggccagttaagccattcatgccagtaggcgcgcggacgaaagtaaacccactggtgataccattcgcgagcctccggatgacgaccgtagtgatgaatctctcctggcgggaacagcaaaatatcacccggtcggcaaacaaattctcgtccctgatttttcaccaccccctgaccgcgaatggtgagattgagaatataacctttcattcccagcggtcggtcgataaaaaaatcgagataaccgttggcctcaatcggcgttaaacccgccaccagatgggcattaaacgagtatcccggcagcaggggatcattttgcgcttcagccatacttttcatactcccaccattcagagaagaaaccaattgtccatattgcatcagacattgccgtcactgcgtcttttactggctcttctcgctaacccaaccggtaaccccgcttattaaaagcattctgtaacaaagcgggaccaaagccatgacaaaaacgcgtaacaaaagtgtctataatcacggcagaaaagtccacattgattatttgcacggcgtcacactttgctatgccatagcatttttatccataagattagcggatcctacctgacgctttttatcgcaactctctactgtttctccatacccgtttttttggacgcgtacaactcaagtctgacataaatgaccgctatgagcactgcaattacacgccagatcgttctcgctaccgcaaccaccggtatgaaccagattggtgcgcactatgaaggccacaagatcattgagattggtgccgttgaagtggtgaaccgtcgcctgacgggcaataacttccatgtttatctcaaacccgatcggctggtggatccggaagcctttggcgtacatggtattgccgatgaatttttgctcgataagcccacgtttgccgaagtagccgatgagttcatggactatattcgcggcgcggagttggtgatccataacgcagcgttcgatatcggctttatggactacgagttttcgttgcttaagcgcgatattccgaagaccaatactttctgtaaggtcaccgatagccttgcggtggcgaggaaaatgtttcccggtaagcgcaacagcctcgatgcgttatgtgctcgctacgaaatagataacagtaaacgaacgctgcacggggcattactcgatgcccagatccttgcggaagtttatctggcgatgaccggtggtcaaacgtcgatggcttttgcgatggaaggagagacacaacagcaacaaggtgaagcaacaattcagcgcattgtacgtcaggcaagtaagttacgcgttgtttttgcgacagatgaagagattgcagctcatgaagcccgtctcgatctggtgcagaagaaaggcggaagttgcctctggcgagcataatttaatatcagtaaaccggacataacccatgaagaaaaatcgcgcttttttgaagtgggcagggggcaagtatcccctgcttgatgatattaaacggcatttgcccaagggcgaatgtctggttgagccttttgtaggtgccgggtcggtgtttctcaacaccgacttttctcgttatatccttgccgatatcaatagcgacctgatcagtctctataacattgtgaagatgcgtactgatgagtacgtacaggccgcacgcgagctgtttgttcccgaaacaaattgcgccgaggtttactatcagttccgcgaagagttcaacaaaagccaggatccgttccgtcgggcggtactgtttttatatttgaaccgctacggttacaacggcctgtgtcgttacaatctgcgcggtgagtttaacgtgccgttcggccgctacaaaaaaccctatttcccggaagcagagttgtatcacttcgctgaaaaagcgcagaatgcctttttctattgtgagtcttacgccgatagcatggcgcgcgcagatgatgcatccgtcgtctattgcgatccgccttatgcaccgctgtctgcgaccgccaactttacggcgtatcacacaaacagttttacgcttgaacaacaagcgcatctggcggagatcgccgaaggtctggttgagcgccatattccagtgctgatctccaatcacgatacgatgttaacgcgtgagtggtatcagcgcgcaaaattgcatgtcgtcaaagttcgacgcagtataagcagcaacggcggcacacgtaaaaaggtggacgaactgctggctttgtacaaaccaggagtcgtttcacccgcgaaaaaataattcagctaagacactgcactggattaagatgaaaacgattgaagttgatgatgaactctacagctatattgccagccacactaagcatatcggcgagagcgcatccgacattttacggcgtatgttgaaattttccgccgcatcacagcctgctgctccggtgacgaaagaggttcgcgttgcgtcacctgctatcgtcgaagcgaagccggtcaaaacgattaaagacaaggttcgcgcaatgcgtgaacttctgctttcggatgaatacgcagagcaaaagcgagcggtcaatcgctttatgctgctgttgtctacactatattctcttgacgcccaggcgtttgccgaagcaacggaatcgttgcacggtcgtacacgcgtttactttgcggcagatgaacaaacgctgctgaaaaatggtaatcagaccaagccgaaacatgtgccaggcacgccgtattgggtgatcaccaacaccaacaccggccgtaaatgcagcatgatcgaacacatcatgcagtcgatgcaattcccggcggaattgattgagaaggtttgcggaactatctaaacttaattaacggcactcctcagccaagtcaaaagcctccgaccggaggcttttgactacatgcccatggcgtttacgccccgccctgccactcatcgcagtactgttgtaattcattaagcattctgccgacatggaagccatcacaaacggcatgatgaacctgaatcgccagcggcatcagcaccttgtcgccttgcgtataatatttgcccatagtgaaaacgggggcgaagaagttgtccatattggccacgtttaaatcaaaactggtgaaactcacccagggattggctgagacgaaaaacatattctcaataaaccctttagggaaataggccaggttttcaccgtaacacgccacatcttgcgaatatatgtgtagaaactgccggaaatcgtcgtggtattcactccagagcgatgaaaacgtttcagtttgctcatggaaaacggtgtaacaagggtgaacactatcccatatcaccagctcaccgtctttcattgccatacggaactccggatgagcattcatcaggcgggcaagaatgtgaataaaggccggataaaacttgtgcttatttttctttacggtctttaaaaaggccgtaatatccagctgaacggtctggttataggtacattgagcaactgactgaaatgcctcaaaatgttctttacgatgccattgggatatatcaacggtggtatatccagtgatttttttctccattttagcttccttagctcctgaaaatctcgataactcaaaaaatacgcccggtagtgatcttatttcattatggtgaaagttggaacctcttacgtgccaagccaaataggccgt

SEQ ID NO: 34 - DNA, 8080 bp, Artificial Sequence
  Synthetic Polynucleotide
cactcggtcgctacgctccgggcgtgagactgcggcgggcgctgcggacacatacaaagttacccacagattccgtggataagcaggggactaacatgtgaggcaaaacagcagggccgcgccggtggcgtttttccataggctccgccctcctgccagagttcacataaacagacgcttttccggtgcatctgtgggagccgtgaggctcaaccatgaatctgacagtacgggcgaaacccgacaggacttaaagatccccaccgtttccggcgggtcgctccctcttgcgctctcctgttccgaccctgccgtttaccggatacctgttccgcctttctcccttacgggaagtgtggcgctttctcatagctcacacactggtatctcggctcggtgtaggtcgttcgctccaagctgggctgtaagcaagaactccccgttcagcccgactgctgcgccttatccggtaactgttcacttgagtccaacccggaaaagcacggtaaaacgccactggcagcagccattggtaactgggagttcgcagaggatttgtttagctaaacacgcggttgctcttgaagtgtgcgccaaagtccggctacactggaaggacagatttggttgctgtgctctgcgaaagccagttaccacggttaagcagttccccaactgacttaaccttcgatcaaaccacctccccaggtggttttttcgtttacagggcaaaagattacgcgcagaaaaaaaggatctcaagaagatcctttgatcttttctactgaaccgctctagatttcagtgcaatttatctcttcaaatgtagcacctgaagtcagcccaggaggaagaggacatccggtcaaataaaacgaaaggctcagtcgaaagactgggcctttcgttttgctgaggagacttagggaccctttaagactccttattacgcagtatgttagcaaacgtagaaaatacatacataaaggtggcaacatataaaagaaacgcaaagacaccgcggaacaggttgatcttatcgcagtcgatactgaactcgtaaggtttaccagcgccaaagacaaaagggcgacattcaaccgattgagggagggaaggtaaatattgacggaaattattcattaaaggtgaattatcaccgtcaccgacttgagccatttgggaattagagccagcaaaatcaccagtagcaccattaccattagcaaggccggaaacgtcaccaatgaaaccatcgatagcagcaccgtaatcagtagcgacagaatcaagtttgcctttagcgtcagactgtagcgcgttttcatcggcattttcggtcatagcccccttattagcgtttgccatcttttcataatcaaaatcaccggaaccagagccaccaccggaaccgcctccctcagagccgccaccctcagaaccgccaccctcagagccaccaccctcagagccgccaccagaaccaccaccagagccgccgccagcattgacaggaggttgaggcaggtcagacgattggccttgatattcacaaacgaatggatcctcattaaagccagaatggaaagcgcagtctctgaatttaccgttccagtaagcgtcatacatggcttttgatgatacaggagtgtactggtaataagttttaacggggtcagtgccttgagtaacagtgcccgtataaacagttaatgccccctgcctatttcggaacctattattctgaaacatgaaagtattaagaggctgagactcctcaagagaaggattaggattagcggggttttgctcagtaccaggcggataagtgccgtcgagagggttgatataagtatagcccggaataggtgtatcaccgtactcaggaggtttagtaccgccaccctcagaaccgccaccctcagaaccgccaccctcagagccaccaccctcattttcagggatagcaagcccaataggaacccatgtaccgtaacactgagtttcgtcaccagtacaaactacaacgcctgtagcattccacagacagccctcatagttagcgtaacgatctaaagttttgtcgtctttccagacgttagtaaatgaattttctgtatggggttttgctaaacaactttcaacagtttcagcggagtgagaatagaaaggaacaactaaaggaattgcgaataataattttttcattttttttttcctttactgcacctgcaggtaatgttgtcctcttgatttctgcgttcaggattgtcctgctctctatcactgatagggatgaactgttaatacaatttgcgtgccaattttttatctttttgatttataaagatctgattgaagaatcaacagcaacatgccaggatgagttagcgaattacactaacaagtggcgaatttcatcacggagccaatgtcctcagcgagtttgtagaaacgcaaaaaggccatccgtcaggatggccttctgcttaatttgatgcctggcagtttatggcgggcgtcctgcccgccaccctccgggccgttgcttcgcaacgttcaaatccgctcccggcggatttgtcctactcaggagagcgttcaccgacaaacaacagataaaacgaaaggcccagtctttcgactgagcctttcgttttatttgatgcctggcagttccctactctcgcatggggagaccccacactaccatcggcgctacggcgtttcacttctgagttcggcatggggtcaggtgggaccaccgcgctactgccgccaggcaaattctgttttatcagaccgcttctgcgttctgatttaatctgtatcaggctgaaaatcttctctcatccgccaaaacagccagggccctactgactgtttatgacaacttgacggctacatcattcactttttcttcacaaccggcacggaactcgctcgggctggccccggtgcattttttaaatacccgcgagaaatagagttgatcgtcaaaaccaacattgcgaccgacggtggcgataggcatccgggtggtgctcaaaagcagcttcgcctggctgatacgttggtcctcgcgccagcttaagacgctaatccctaactgctggcggaaaagatgtgacagacgcgacggcgacaagcaaacatgctgtgcgacgctggcgatatcaaaattgctgtctgccaggtgatcgctgatgtactgacaagcctcgcgtacccgattatccatcggtggatggagcgactcgttaatcgcttccatgcgccgcagtaacaattgctcaagcagatttatcgccagcagctccgaatagcgcccttccccttgcccggcgttaatgatttgcccaaacaggtcgctgaaatgcggctggtgcgcttcatccgggcgaaagaaccccgtattggcaaatattgacggccagttaagccattcatgccagtaggcgcgcggacgaaagtaaacccactggtgataccattcgcgagcctccggatgacgaccgtagtgatgaatctctcctggcgggaacagcaaaatatcacccggtcggcaaacaaattctcgtccctgatttttcaccaccccctgaccgcgaatggtgagattgagaatataacctttcattcccagcggtcggtcgataaaaaaatcgagataaccgttggcctcaatcggcgttaaacccgccaccagatgggcattaaacgagtatcccggcagcaggggatcattttgcgcttcagccatacttttcatactcccaccattcagagaagaaaccaattgtccatattgcatcagacattgccgtcactgcgtcttttactggctcttctcgctaacccaaccggtaaccccgcttattaaaagcattctgtaacaaagcgggaccaaagccatgacaaaaacgcgtaacaaaagtgtctataatcacggcagaaaagtccacattgattatttgcacggcgtcacactttgctatgccatagcatttttatccataagattagcggatcctacctgacgctttttatcgcaactctctactgtttctccatacccgtttttttggacgcgtacaactcaagtctgacataaatgaccgctatgagcactgcaattacacgccagatcgttctcgctaccgcaaccaccggtatgaaccagattggtgcgcactatgaaggccacaagatcattgagattggtgccgttgaagtggtgaaccgtcgcctgacgggcaataacttccatgtttatctcaaacccgatcggctggtggatccggaagcctttggcgtacatggtattgccgatgaatttttgctcgataagcccacgtttgccgaagtagccgatgagttcatggactatattcgcggcgcggagttggtgatccataacgcagcgttcgatatcggctttatggactacgagttttcgttgcttaagcgcgatattccgaagaccaatactttctgtaaggtcaccgatagccttgcggtggcgaggaaaatgtttcccggtaagcgcaacagcctcgatgcgttatgtgctcgctacgaaatagataacagtaaacgaacgctgcacggggcattactcgatgcccagatccttgcggaagtttatctggcgatgaccggtggtcaaacgtcgatggcttttgcgatggaaggagagacacaacagcaacaaggtgaagcaacaattcagcgcattgtacgtcaggcaagtaagttacgcgttgtttttgcgacagatgaagagattgcagctcatgaagcccgtctcgatctggtgcagaagaaaggcggaagttgcctctggcgagcataatttaatatcagtaaaccggacataacccatgaagaaaaatcgcgcttttttgaagtgggcagggggcaagtatcccctgcttgatgatattaaacggcatttgcccaagggcgaatgtctggttgagccttttgtaggtgccgggtcggtgtttctcaacaccgacttttctcgttatatccttgccgatatcaatagcgacctgatcagtctctataacattgtgaagatgcgtactgatgagtacgtacaggccgcacgcgagctgtttgttcccgaaacaaattgcgccgaggtttactatcagttccgcgaagagttcaacaaaagccaggatccgttccgtcgggcggtactgtttttatatttgaaccgctacggttacaacggcctgtgtcgttacaatctgcgcggtgagtttaacgtgccgttcggccgctacaaaaaaccctatttcccggaagcagagttgtatcacttcgctgaaaaagcgcagaatgcctttttctattgtgagtcttacgccgatagcatggcgcgcgcagatgatgcatccgtcgtctattgcgatccgccttatgcaccgctgtctgcgaccgccaactttacggcgtatcacacaaacagttttacgcttgaacaacaagcgcatctggcggagatcgccgaaggtctggttgagcgccatattccagtgctgatctccaatcacgatacgatgttaacgcgtgagtggtatcagcgcgcaaaattgcatgtcgtcaaagttcgacgcagtataagcagcaacggcggcacacgtaaaaaggtggacgaactgctggctttgtacaaaccaggagtcgtttcacccgcgaaaaaataattcagctaagacactgcactggattaagatgaaaacgattgaagttgatgatgaactctacagctatattgccagccacactaagcatatcggcgagagcgcatccgacattttacggcgtatgttgaaattttccgccgcatcacagcctgctgctccggtgacgaaagaggttcgcgttgcgtcacctgctatcgtcgaagcgaagccggtcaaaacgattaaagacaaggttcgcgcaatgcgtgaacttctgctttcggatgaatacgcagagcaaaagcgagcggtcaatcgctttatgctgctgttgtctacactatattctcttgacgcccaggcgtttgccgaagcaacggaatcgttgcacggtcgtacacgcgtttactttgcggcagatgaacaaacgctgctgaaaaatggtaatcagaccaagccgaaacatgtgccaggcacgccgtattgggtgatcaccaacaccaacaccggccgtaaatgcagcatgatcgaacacatcatgcagtcgatgcaattcccggcggaattgattgagaaggtttgcggaactatctaataatacaaaaattaggaggaatttcaacatgacaaatttatctgacatcattgaaaaagaaacaggaaaacaactagtgattcaagaatcaattctaatgttaccagaagaagtagaggaagtaattgggaataaaccagaaagtgatattttagttcatactgcttatgatgaaagtacagatgaaaatgtaatgctattaacttcagatgctccagaatataaaccttgggctttagtaattcaagacagtaatggagaaaataaaattaaaatgttataagtcgagattaagtaaaccggaatctgaagatgaccgacgcggaatacgttcgtatccacgaaaaactggacatctacaccttcaaaaaacagttcttcaacaacaaaaaatctgtttctcaccgttgctacgttctgttcgaactgaaacgtcgtggtgaacgtcgtgcgtgcttctggggttacgcggttaacaaaccgcagtctggtaccgaacgtggtatccacgcggaaatcttctctatccgtaaagttgaagaatacctgcgtgacaacccgggtcagttcaccatcaactggtactcttcttggtctccgtgcgcggactgcgcggaaaaaatcctggaatggtacaaccaggaactgcgtggtaacggtcacaccctgaaaatctgggcgtgcaaactgtactacgaaaaaaacgcgcgtaaccagatcggtctgtggaacctgcgtgacaacggtgttggtctgaacgttatggtttctgaacactaccagtgctgccgtaaaatcttcatccagtcttctcacaaccagctgaacgaaaaccgttggctggaaaaaaccctgaaacgtgcggaaaaacgtcgttctgaactgtctatcatgatccaggttaaaatcctgcacaccaccaaatctccggcggtttaaacttaattaacggcactcctcagccaagtcaaaagcctccgaccggaggcttttgactacatgcccatggcgtttacgccccgccctgccactcatcgcagtactgttgtaattcattaagcattctgccgacatggaagccatcacaaacggcatgatgaacctgaatcgccagcggcatcagcaccttgtcgccttgcgtataatatttgcccatagtgaaaacgggggcgaagaagttgtccatattggccacgtttaaatcaaaactggtgaaactcacccagggattggctgagacgaaaaacatattctcaataaaccctttagggaaataggccaggttttcaccgtaacacgccacatcttgcgaatatatgtgtagaaactgccggaaatcgtcgtggtattcactccagagcgatgaaaacgtttcagtttgctcatggaaaacggtgtaacaagggtgaacactatcccatatcaccagctcaccgtctttcattgccatacggaactccggatgagcattcatcaggcgggcaagaatgtgaataaaggccggataaaacttgtgcttatttttctttacggtctttaaaaaggccgtaatatccagctgaacggtctggttataggtacatttagcaactgactgaaatgcctcaaaatgttctttacgatgccattgggatatatcaacggtggtatatccagtgatttttttctccattttagcttccttagctcctgaaaatctcgataactcaaaaaatacgcccggtagtgatcttatttcattatggtgaaagttggaacctcttacgtgccaagccaaataggccgt

SEQ ID NO: 35 - DNA, 8639 bp, Artificial Sequence
  Synthetic Polynucleotide
cactcggtcgctacgctccgggcgtgagactgcggcgggcgctgcggacacatacaaagttacccacagattccgtggataagcaggggactaacatgtgaggcaaaacagcagggccgcgccggtggcgtttttccataggctccgccctcctgccagagttcacataaacagacgcttttccggtgcatctgtgggagccgtgaggctcaaccatgaatctgacagtacgggcgaaacccgacaggacttaaagatccccaccgtttccggcgggtcgctccctcttgcgctctcctgttccgaccctgccgtttaccggatacctgttccgcctttctcccttacgggaagtgtggcgctttctcatagctcacacactggtatctcggctcggtgtaggtcgttcgctccaagctgggctgtaagcaagaactccccgttcagcccgactgctgcgccttatccggtaactgttcacttgagtccaacccggaaaagcacggtaaaacgccactggcagcagccattggtaactgggagttcgcagaggatttgtttagctaaacacgcggttgctcttgaagtgtgcgccaaagtccggctacactggaaggacagatttggttgctgtgctctgcgaaagccagttaccacggttaagcagttccccaactgacttaaccttcgatcaaaccacctccccaggtggttttttcgtttacagggcaaaagattacgcgcagaaaaaaaggatctcaagaagatcctttgatcttttctactgaaccgctctagatttcagtgcaatttatctcttcaaatgtagcacctgaagtcagcccaggaggaagaggacatccggtcaaataaaacgaaaggctcagtcgaaagactgggcctttcgttttgctgaggagacttagggaccctttaagactccttattacgcagtatgttagcaaacgtagaaaatacatacataaaggtggcaacatataaaagaaacgcaaagacaccgcggaacaggttgatcttatcgcagtcgatactgaactcgtaaggtttaccagcgccaaagacaaaagggcgacattcaaccgattgagggagggaaggtaaatattgacggaaattattcattaaaggtgaattatcaccgtcaccgacttgagccatttgggaattagagccagcaaaatcaccagtagcaccattaccattagcaaggccggaaacgtcaccaatgaaaccatcgatagcagcaccgtaatcagtagcgacagaatcaagtttgcctttagcgtcagactgtagcgcgttttcatcggcattttcggtcatagcccccttattagcgtttgccatcttttcataatcaaaatcaccggaaccagagccaccaccggaaccgcctccctcagagccgccaccctcagaaccgccaccctcagagccaccaccctcagagccgccaccagaaccaccaccagagccgccgccagcattgacaggaggttgaggcaggtcagacgattggccttgatattcacaaacgaatggatcctcattaaagccagaatggaaagcgcagtctctgaatttaccgttccagtaagcgtcatacatggcttttgatgatacaggagtgtactggtaataagttttaacggggtcagtgccttgagtaacagtgcccgtataaacagttaatgccccctgcctatttcggaacctattattctgaaacatgaaagtattaagaggctgagactcctcaagagaaggattaggattagcggggttttgctcagtaccaggcggataagtgccgtcgagagggttgatataagtatagcccggaataggtgtatcaccgtactcaggaggtttagtaccgccaccctcagaaccgccaccctcagaaccgccaccctcagagccaccaccctcattttcagggatagcaagcccaataggaacccatgtaccgtaacactgagtttcgtcaccagtacaaactacaacgcctgtagcattccacagacagccctcatagttagcgtaacgatctaaagttttgtcgtctttccagacgttagtaaatgaattttctgtatggggttttgctaaacaactttcaacagtttcagcggagtgagaatagaaaggaacaactaaaggaattgcgaataataattttttcattttttttttcctttactgcacctgcaggtaatgttgtcctcttgatttctgcgttcaggattgtcctgctctctatcactgatagggatgaactgttaatacaatttgcgtgccaattttttatctttttgatttataaagatctgattgaagaatcaacagcaacatgccaggatgagttagcgaattacactaacaagtggcgaatttcatcacggagccaatgtcctcagcgagtttgtagaaacgcaaaaaggccatccgtcaggatggccttctgcttaatttgatgcctggcagtttatggcgggcgtcctgcccgccaccctccgggccgttgcttcgcaacgttcaaatccgctcccggcggatttgtcctactcaggagagcgttcaccgacaaacaacagataaaacgaaaggcccagtctttcgactgagcctttcgttttatttgatgcctggcagttccctactctcgcatggggagaccccacactaccatcggcgctacggcgtttcacttctgagttcggcatggggtcaggtgggaccaccgcgctactgccgccaggcaaattctgttttatcagaccgcttctgcgttctgatttaatctgtatcaggctgaaaatcttctctcatccgccaaaacagccagggccctactgactgtttatgacaacttgacggctacatcattcactttttcttcacaaccggcacggaactcgctcgggctggccccggtgcattttttaaatacccgcgagaaatagagttgatcgtcaaaaccaacattgcgaccgacggtggcgataggcatccgggtggtgctcaaaagcagcttcgcctggctgatacgttggtcctcgcgccagcttaagacgctaatccctaactgctggcggaaaagatgtgacagacgcgacggcgacaagcaaacatgctgtgcgacgctggcgatatcaaaattgctgtctgccaggtgatcgctgatgtactgacaagcctcgcgtacccgattatccatcggtggatggagcgactcgttaatcgcttccatgcgccgcagtaacaattgctcaagcagatttatcgccagcagctccgaatagcgcccttccccttgcccggcgttaatgatttgcccaaacaggtcgctgaaatgcggctggtgcgcttcatccgggcgaaagaaccccgtattggcaaatattgacggccagttaagccattcatgccagtaggcgcgcggacgaaagtaaacccactggtgataccattcgcgagcctccggatgacgaccgtagtgatgaatctctcctggcgggaacagcaaaatatcacccggtcggcaaacaaattctcgtccctgatttttcaccaccccctgaccgcgaatggtgagattgagaatataacctttcattcccagcggtcggtcgataaaaaaatcgagataaccgttggcctcaatcggcgttaaacccgccaccagatgggcattaaacgagtatcccggcagcaggggatcattttgcgcttcagccatacttttcatactcccaccattcagagaagaaaccaattgtccatattgcatcagacattgccgtcactgcgtcttttactggctcttctcgctaacccaaccggtaaccccgcttattaaaagcattctgtaacaaagcgggaccaaagccatgacaaaaacgcgtaacaaaagtgtctataatcacggcagaaaagtccacattgattatttgcacggcgtcacactttgctatgccatagcatttttatccataagattagcggatcctacctgacgctttttatcgcaactctctactgtttctccatacccgtttttttggacgcgtacaactcaagtctgacataaatgaccgctatgagcactgcaattacacgccagatcgttctcgctaccgcaaccaccggtatgaaccagattggtgcgcactatgaaggccacaagatcattgagattggtgccgttgaagtggtgaaccgtcgcctgacgggcaataacttccatgtttatctcaaacccgatcggctggtggatccggaagcctttggcgtacatggtattgccgatgaatttttgctcgataagcccacgtttgccgaagtagccgatgagttcatggactatattcgcggcgcggagttggtgatccataacgcagcgttcgatatcggctttatggactacgagttttcgttgcttaagcgcgatattccgaagaccaatactttctgtaaggtcaccgatagccttgcggtggcgaggaaaatgtttcccggtaagcgcaacagcctcgatgcgttatgtgctcgctacgaaatagataacagtaaacgaacgctgcacggggcattactcgatgcccagatccttgcggaagtttatctggcgatgaccggtggtcaaacgtcgatggcttttgcgatggaaggagagacacaacagcaacaaggtgaagcaacaattcagcgcattgtacgtcaggcaagtaagttacgcgttgtttttgcgacagatgaagagattgcagctcatgaagcccgtctcgatctggtgcagaagaaaggcggaagttgcctctggcgagcataatttaatatcagtaaaccggacataacccatgaagaaaaatcgcgcttttttgaagtgggcagggggcaagtatcccctgcttgatgatattaaacggcatttgcccaagggcgaatgtctggttgagccttttgtaggtgccgggtcggtgtttctcaacaccgacttttctcgttatatccttgccgatatcaatagcgacctgatcagtctctataacattgtgaagatgcgtactgatgagtacgtacaggccgcacgcgagctgtttgttcccgaaacaaattgcgccgaggtttactatcagttccgcgaagagttcaacaaaagccaggatccgttccgtcgggcggtactgtttttatatttgaaccgctacggttacaacggcctgtgtcgttacaatctgcgcggtgagtttaacgtgccgttcggccgctacaaaaaaccctatttcccggaagcagagttgtatcacttcgctgaaaaagcgcagaatgcctttttctattgtgagtcttacgccgatagcatggcgcgcgcagatgatgcatccgtcgtctattgcgatccgccttatgcaccgctgtctgcgaccgccaactttacggcgtatcacacaaacagttttacgcttgaacaacaagcgcatctggcggagatcgccgaaggtctggttgagcgccatattccagtgctgatctccaatcacgatacgatgttaacgcgtgagtggtatcagcgcgcaaaattgcatgtcgtcaaagttcgacgcagtataagcagcaacggcggcacacgtaaaaaggtggacgaactgctggctttgtacaaaccaggagtcgtttcacccgcgaaaaaataattcagctaagacactgcactggattaagatgaaaacgattgaagttgatgatgaactctacagctatattgccagccacactaagcatatcggcgagagcgcatccgacattttacggcgtatgttgaaattttccgccgcatcacagcctgctgctccggtgacgaaagaggttcgcgttgcgtcacctgctatcgtcgaagcgaagccggtcaaaacgattaaagacaaggttcgcgcaatgcgtgaacttctgctttcggatgaatacgcagagcaaaagcgagcggtcaatcgctttatgctgctgttgtctacactatattctcttgacgcccaggcgtttgccgaagcaacggaatcgttgcacggtcgtacacgcgtttactttgcggcagatgaacaaacgctgctgaaaaatggtaatcagaccaagccgaaacatgtgccaggcacgccgtattgggtgatcaccaacaccaacaccggccgtaaatgcagcatgatcgaacacatcatgcagtcgatgcaattcccggcggaattgattgagaaggtttgcggaactatctaacggctgaaattaatgaggtcatacccaaatggatagttcgtttacgcccattgaacaaatgctaaaatttcgcgccagccgccacgaagattttccttatcaggagatccttctgactcgtctttgcatgcacatgcaaagcaagctgctggagaaccgcaataaaatgctgaaggctcagggaattaacgagacgttgtttatggcgttgattacgctggagtctcaggaaaaccacagtattcagccttctgaattaagttgtgctcttggatcatcccgtaccaacgcgacgcgtattgccgatgaactggaaaaacgcggttggatcgaacgtcgtgaaagcgataacgatcgccgctgcctgcatctgcaattaacggaaaaaggtcacgagtttttgcgcgaggttttaccaccgcagcataactgcctgcatcaactctggtccgcgctcagcacaacagaaaaagatcagctcgagcaaatcacccgcaaattgctctcccgtctcgaccagatggaacaagacggtgtggttctcgaagcgatgagctaataatacaaaaattaggaggaatttcaacatgacaaatttatctgacatcattgaaaaagaaacaggaaaacaactagtgattcaagaatcaattctaatgttaccagaagaagtagaggaagtaattgggaataaaccagaaagtgatattttagttcatactgcttatgatgaaagtacagatgaaaatgtaatgctattaacttcagatgctccagaatataaaccttgggctttagtaattcaagacagtaatggagaaaataaaattaaaatgttataagtcgagattaagtaaaccggaatctgaagatgaccgacgcggaatacgttcgtatccacgaaaaactggacatctacaccttcaaaaaacagttcttcaacaacaaaaaatctgtttctcaccgttgctacgttctgttcgaactgaaacgtcgtggtgaacgtcgtgcgtgcttctggggttacgcggttaacaaaccgcagtctggtaccgaacgtggtatccacgcggaaatcttctctatccgtaaagttgaagaatacctgcgtgacaacccgggtcagttcaccatcaactggtactcttcttggtctccgtgcgcggactgcgcggaaaaaatcctggaatggtacaaccaggaactgcgtggtaacggtcacaccctgaaaatctgggcgtgcaaactgtactacgaaaaaaacgcgcgtaaccagatcggtctgtggaacctgcgtgacaacggtgttggtctgaacgttatggtttctgaacactaccagtgctgccgtaaaatcttcatccagtcttctcacaaccagctgaacgaaaaccgttggctggaaaaaaccctgaaacgtgcggaaaaacgtcgttctgaactgtctatcatgatccaggttaaaatcctgcacaccaccaaatctccggcggtttaaacttaattaacggcactcctcagccaagtcaaaagcctccgaccggaggcttttgactacatgcccatggcgtttacgccccgccctgccactcatcgcagtactgttgtaattcattaagcattctgccgacatggaagccatcacaaacggcatgatgaacctgaatcgccagcggcatcagcaccttgtcgccttgcgtataatatttgcccatagtgaaaacgggggcgaagaagttgtccatattggccacgtttaaatcaaaactggtgaaactcacccagggattggctgagacgaaaaacatattctcaataaaccctttagggaaataggccaggttttcaccgtaacacgccacatcttgcgaatatatgtgtagaaactgccggaaatcgtcgtggtattcactccagagcgatgaaaacgtttcagtttgctcatggaaaacggtgtaacaagggtgaacactatcccatatcaccagctcaccgtctttcattgccatacggaactccggatgagcattcatcaggcgggcaagaatgtgaataaaggccggataaaacttgtgcttatttttctttacggtctttaaaaaggccgtaatatccagctgaacggtctggttataggtacatttagcaactgactgaaatgcctcaaaatgttctttacgatgccattgggatatatcaacggtggtatatccagtgatttttttctccattttagcttccttagctcctgaaaatctcgataactcaaaaaatacgcccggtagtgatcttatttcattatggtgaaagttggaacctcttacgtgccaagccaaataggccgt

SEQ ID NO: 36 - DNA, 877 bp, Artificial Sequence
  Synthetic Polynucleotide
atgacaacttgacggctacatcattcactttttcttcacaaccggcacggaactcgctcgggctggccccggtgcattttttaaatacccgcgagaaatagagttgatcgtcaaaaccaacattgcgaccgacggtggcgataggcatccgggtggtgctcaaaagcagcttcgcctggctgatacgttggtcctcgcgccagcttaagacgctaatccctaactgctggcggaaaagatgtgacagacgcgacggcgacaagcaaacatgctgtgcgacgctggcgatatcaaaattgctgtctgccaggtgatcgctgatgtactgacaagcctcgcgtacccgattatccatcggtggatggagcgactcgttaatcgcttccatgcgccgcagtaacaattgctcaagcagatttatcgccagcagctccgaatagcgcccttccccttgcccggcgttaatgatttgcccaaacaggtcgctgaaatgcggctggtgcgcttcatccgggcgaaagaaccccgtattggcaaatattgacggccagttaagccattcatgccagtaggcgcgcggacgaaagtaaacccactggtgataccattcgcgagcctccggatgacgaccgtagtgatgaatctctcctggcgggaacagcaaaatatcacccggtcggcaaacaaattctcgtccctgatttttcaccaccccctgaccgcgaatggtgagattgagaatataacctttcattcccagcggtcggtcgataaaaaaatcgagataaccgttggcctcaatcggcgttaaacccgccaccagatgggcattaaacgagtatcccggcagcaggggatcattttgcgcttcagccat

SEQ ID NO: 37 - DNA, 732 bp, Artificial Sequence
  Synthetic Polynucleotide
atgagcactgcaattacacgccagatcgttctcgctaccgcaaccaccggtatgaaccagattggtgcgcactatgaaggccacaagatcattgagattggtgccgttgaagtggtgaaccgtcgcctgacgggcaataacttccatgtttatctcaaacccgatcggctggtggatccggaagcctttggcgtacatggtattgccgatgaatttttgctcgataagcccacgtttgccgaagtagccgatgagttcatggactatattcgcggcgcggagttggtgatccataacgcagcgttcgatatcggctttatggactacgagttttcgttgcttaagcgcgatattccgaagaccaatactttctgtaaggtcaccgatagccttgcggtggcgaggaaaatgtttcccggtaagcgcaacagcctcgatgcgttatgtgctcgctacgaaatagataacagtaaacgaacgctgcacggggcattactcgatgcccagatccttgcggaagtttatctggcgatgaccggtggtcaaacgtcgatggcttttgcgatggaaggagagacacaacagcaacaaggtgaagcaacaattcagcgcattgtacgtcaggcaagtaagttacgcgttgtttttgcgacagatgaagagattgcagctcatgaagcccgtctcgatctggtgcagaagaaaggcggaagttgcctctggcgagcataa

SEQ ID NO: 38 - DNA, 837 bp, Artificial Sequence
  Synthetic Polynucleotide
atgaagaaaaatcgcgcttttttgaagtgggcagggggcaagtatcccctgcttgatgatattaaacggcatttgcccaagggcgaatgtctggttgagccttttgtaggtgccgggtcggtgtttctcaacaccgacttttctcgttatatccttgccgatatcaatagcgacctgatcagtctctataacattgtgaagatgcgtactgatgagtacgtacaggccgcacgcgagctgtttgttcccgaaacaaattgcgccgaggtttactatcagttccgcgaagagttcaacaaaagccaggatccgttccgtcgggcggtactgtttttatatttgaaccgctacggttacaacggcctgtgtcgttacaatctgcgcggtgagtttaacgtgccgttcggccgctacaaaaaaccctatttcccggaagcagagttgtatcacttcgctgaaaaagcgcagaatgcctttttctattgtgagtcttacgccgatagcatggcgcgcgcagatgatgcatccgtcgtctattgcgatccgccttatgcaccgctgtctgcgaccgccaactttacggcgtatcacacaaacagttttacgcttgaacaacaagcgcatctggcggagatcgccgaaggtctggttgagcgccatattccagtgctgatctccaatcacgatacgatgttaacgcgtgagtggtatcagcgcgcaaaattgcatgtcgtcaaagttcgacgcagtataagcagcaacggcggcacacgtaaaaaggtggacgaactgctggctttgtacaaaccaggagtcgtttcacccgcgaaaaaataa

SEQ ID NO: 39 - DNA, 546 bp, Artificial Sequence
  Synthetic Polynucleotide
atgaaaacgattgaagttgatgatgaactctacagctatattgccagccacactaagcatatcggcgagagcgcatccgacattttacggcgtatgttgaaattttccgccgcatcacagcctgctgctccggtgacgaaagaggttcgcgttgcgtcacctgctatcgtcgaagcgaagccggtcaaaacgattaaagacaaggttcgcgcaatgcgtgaacttctgctttcggatgaatacgcagagcaaaagcgagcggtcaatcgctttatgctgctgttgtctacactatattctcttgacgcccaggcgtttgccgaagcaacggaatcgttgcacggtcgtacacgcgtttactttgcggcagatgaacaaacgctgctgaaaaatggtaatcagaccaagccgaaacatgtgccaggcacgccgtattgggtgatcaccaacaccaacaccggccgtaaatgcagcatgatcgaacacatcatgcagtcgatgcaattcccggcggaattgattgagaaggtttgcggaactatctaa

SEQ ID NO: 40 - DNA, 531 bp, Artificial Sequence
  Synthetic Polynucleotide
atggatagttcgtttacgcccattgaacaaatgctaaaatttcgcgccagccgccacgaagattttccttatcaggagatccttctgactcgtctttgcatgcacatgcaaagcaagctgctggagaaccgcaataaaatgctgaaggctcagggaattaacgagacgttgtttatggcgttgattacgctggagtctcaggaaaaccacagtattcagccttctgaattaagttgtgctcttggatcatcccgtaccaacgcgacgcgtattgccgatgaactggaaaaacgcggttggatcgaacgtcgtgaaagcgataacgatcgccgctgcctgcatctgcaattaacggaaaaaggtcacgagtttttgcgcgaggttttaccaccgcagcataactgcctgcatcaactctggtccgcgctcagcacaacagaaaaagatcagctcgagcaaatcacccgcaaattgctctcccgtctcgaccagatggaacaagacggtgtggttctcgaagcgatgagctaa

SEQ ID NO: 41 - DNA, 255 bp, Artificial Sequence
  Synthetic Polynucleotide
atgacaaatttatctgacatcattgaaaaagaaacaggaaaacaactagtgattcaagaatcaattctaatgttaccagaagaagtagaggaagtaattgggaataaaccagaaagtgatattttagttcatactgcttatgatgaaagtacagatgaaaatgtaatgctattaacttcagatgctccagaatataaaccttgggctttagtaattcaagacagtaatggagaaaataaaattaaaatgttataa

SEQ ID NO: 42 - DNA, 627 bp, Artificial Sequence
  Synthetic Polynucleotide
atgaccgacgcggaatacgttcgtatccacgaaaaactggacatctacaccttcaaaaaacagttcttcaacaacaaaaaatctgtttctcaccgttgctacgttctgttcgaactgaaacgtcgtggtgaacgtcgtgcgtgcttctggggttacgcggttaacaaaccgcagtctggtaccgaacgtggtatccacgcggaaatcttctctatccgtaaagttgaagaatacctgcgtgacaacccgggtcagttcaccatcaactggtactcttcttggtctccgtgcgcggactgcgcggaaaaaatcctggaatggtacaaccaggaactgcgtggtaacggtcacaccctgaaaatctgggcgtgcaaactgtactacgaaaaaaacgcgcgtaaccagatcggtctgtggaacctgcgtgacaacggtgttggtctgaacgttatggtttctgaacactaccagtgctgccgtaaaatcttcatccagtcttctcacaaccagctgaacgaaaaccgttggctggaaaaaaccctgaaacgtgcggaaaaacgtcgttctgaactgtctatcatgatccaggttaaaatcctgcacaccaccaaatctccggcggtttaa

SEQ ID NO: 43 - DNA, 3896 bp, Artificial Sequence
  Synthetic Polynucleotide
gtctgacataaatgaccgctatgagcactgcaattacacgccagatcgttctcgctaccgcaaccaccggtatgaaccagattggtgcgcactatgaaggccacaagatcattgagattggtgccgttgaagtggtgaaccgtcgcctgacgggcaataacttccatgtttatctcaaacccgatcggctggtggatccggaagcctttggcgtacatggtattgccgatgaatttttgctcgataagcccacgtttgccgaagtagccgatgagttcatggactatattcgcggcgcggagttggtgatccataacgcagcgttcgatatcggctttatggactacgagttttcgttgcttaagcgcgatattccgaagaccaatactttctgtaaggtcaccgatagccttgcggtggcgaggaaaatgtttcccggtaagcgcaacagcctcgatgcgttatgtgctcgctacgaaatagataacagtaaacgaacgctgcacggggcattactcgatgcccagatccttgcggaagtttatctggcgatgaccggtggtcaaacgtcgatggcttttgcgatggaaggagagacacaacagcaacaaggtgaagcaacaattcagcgcattgtacgtcaggcaagtaagttacgcgttgtttttgcgacagatgaagagattgcagctcatgaagcccgtctcgatctggtgcagaagaaaggcggaagttgcctctggcgagcataaaccggtatgcctcacacaggaaacagaattcattaccatgggctttccttcaccggcagcagattacgttgaacagcgcatcgatctgaatcaactgttgatccagcatcccagcgcgacttacttcgtcaaagcaagtggtgattctatgattgatggtggaattagtgacggtgatttactgattgtcgatagcgctattaccgccagccatggtgatattgtcatcgctgctgttgacggcgagtttacggtgaaaaaattgcaactacgcccgacggtacagcttattcccatgaacagcgcgtactcgcccattaccatcagtagtgaagatacgctggatgtctttggtgtggtgatccacgtcgttaaggcgatgcgctgatgtttgccctctgtgatgtaaacgcgttttatgccagctgtgagacggtgtttcgccctgatttatggggtaaaccggtggttgtgctatcgaataatgacggttgcgttatcgcccgaaacgctgaggcaaaggcgcttggcgttaaaatgggcgatccctggttcaaacaaaaagatctgtttcgtcgctgtggcgtggtttgctttagcagcaattatgagctttacgcagacatgagcaatcgggtgatgtcgacgctggaagagctatcgccccgcgtcgagatttacagtaccggtatgcctattgatgaggcattctgcgatctgacaggtgtgcgtaattgtcgcgatctgactgattttggcagagaaattcgcgcaacggtgctacaacgtacccatcttactgttggtgtggggatcgcccagaccaaaacgctggctaagcttgccaatcatgcggcaaaaaaatggcagcggcagacgggtggggtggtggatttatcaaatctggaacgccagcgtaaattaatgtctgctctccccgtggatgacgtctgggggattggacggcggatcagcaaaaaactggacgcgatggggatcaaaaccgttctcgatttggcggatacagatatccggtttatccgtaaacattttaatgtcgtgctcgaaagaacggtgcgtgaactgcgcggcgaaccctgtttgcaactggaagagtttgcaccgacgaagcaggaaattatctgttcccgctcgtttggtgaacgcatcacggattatccgtcgatgcggcaggccatttgtagttacgctgcccgggcggcggaaaaacttcgcagcgagcatcaatattgtcgattaatttccacgtttattaagacgtcaccatttgcgctcaatgaaccttattacggcaatagcgcgtcggtaaaactgctgacgcccactcaggacagcagggatatcattaacgctgctacgcgatctctggatgccatctggcaagcgggccatcgttaccaaaaagcgggcgtgatgctgggggatttcttcagtcagggagtcgcgcagctcaatttattcgatgacaacgcaccgcgccccgggagtgagcaattgatgacggtaatggatacactgaatgctaaagagggcagaggaacactctattttgccgggcaggggatccagcaacaatggcagatgaagcgagccatgctttcaccacgttatacaacgcgaagttctgatttactgagggtcaaataaatatagcggcaggaaaaaagcgatcccgcatatccggtattacccggcatgacaggagtaaaaatggctatcgacgaaaacaaacagaaagcgttggcggcagcactgggccagattgagaaacaatttggtaaaggctccatcatgcgcctgggtgaagaccgttccatggatgtgaaaaccatctctaccggttcgctttcactggatatcgcgcttggggcaggtggtctgccgatgggccgtatcgtcgaaatctacggaccggaatcttccggtaaaaccacgctgacgctgcaggtgatcgccgcagcgcagcgtgaaggtaaaacctgtgcgtttatcgatgctgaacacgcgctggacccaatctacgcacgtaaactgggcgtcgatatcgataacctgctgtgctcccagccggacaccggcgagcaggcactggaaatctgtgacgccctggcgcgttctggcgcagtagacgttatcgtcgttgactccgtggcggcactgacgccgaaagcggaaatcgaaggcgaaatcggcgactctcacatgggccttgcggcacgtatgatgagccaggcgatgcgtaagctggcgggtaacctgaagcagtccaacacgctgctgatcttcatcaaccagatccgtatgaaaattggtgtgatgttcggtaacccggaaaccactaccggtggtaacgcgctgaaattctacgcctctgttcgtctcgacatccgtcgtatcggcgcggtgaaagagggcgaaaacgtggtgggtagcgaaacccgcgtgaaagtggtgaagaacaaaatcgctgcgccgtttaaacaggctgaattccagatcctctacggcgaaggtatcaacttctacggcgaactggttgacctgggcgtaaaagagaagctgatcgagaaagcaggcgcgtggtacagctacaaaggtgagaagatcggtcagggtaaagcgaatgcgactgcctggctgaaagataacccggaaaccgcgaaagagatcgagaagaaagtacgtgagttgctgctgagcaacccgaactcaacgccggatttctctgtagatgatagcgaaggcgtagcagaaactaacgaagatttttaaacttaattaacggcactcctcagccaagtcaaaagcctccgaccggaggcttttgactacatgcccatggcgtttacgccccgccctgccactcatcgcagtactgttgtaattcattaagcattctgccgacatggaagccatcacaaacggcatgatgaacctgaatcgccagcggcatcagcaccttgtcgccttgcgtataatatttgcccatagtgaaaacgggggcgaagaagttgtccatattggccacgtttaaatcaaaactggtgaaactcacccagggattggctgagacgaaaaacatattctcaataaaccctttagggaaataggccaggttttcac

SEQ ID NO: 44 - DNA, 3744 bp, Artificial Sequence
  Synthetic Polynucleotide
gtctgacataaatgaccgctatgagcactgcaattacacgccagatcgttctcgctaccgcaaccaccggtatgaaccagattggtgcgcactatgaaggccacaagatcattgagattggtgccgttgaagtggtgaaccgtcgcctgacgggcaataacttccatgtttatctcaaacccgatcggctggtggatccggaagcctttggcgtacatggtattgccgatgaatttttgctcgataagcccacgtttgccgaagtagccgatgagttcatggactatattcgcggcgcggagttggtgatccataacgcagcgttcgatatcggctttatggactacgagttttcgttgcttaagcgcgatattccgaagaccaatactttctgtaaggtcaccgatagccttgcggtggcgaggaaaatgtttcccggtaagcgcaacagcctcgatgcgttatgtgctcgctacgaaatagataacagtaaacgaacgctgcacggggcattactcgatgcccagatccttgcggaagtttatctggcgatgaccggtggtcaaacgtcgatggcttttgcgatggaaggagagacacaacagcaacaaggtgaagcaacaattcagcgcattgtacgtcaggcaagtaagttacgcgttgtttttgcgacagatgaagagattgcagctcatgaagcccgtctcgatctggtgcagaagaaaggcggaagttgcctctggcgagcataaacttaattaacggcactcctcagccaagtcaaaagcctccgaccggaggcttttgactacatgcccatggcgtttacgccccgccctgccactcatcgcagtactgttgtaattcattaagcattctgccgacatggaagccatcacaaacggcatgatgaacctgaatcgccagcggcatcagcaccttgtcgccttgcgtataatatttgcccatagtgaaaacgggggcgaagaagttgtccatattggccacgtttaaatcaaaactggtgaaactcacccagggattggctgagacgaaaaacatattctcaataaaccctttagggaaataggccaggttttcaccgtaacacgccacatcttgcgaatatatgtgtagaaactgccggaaatcgtcgtggtattcactccagagcgatgaaaacgtttcagtttgctcatggaaaacggtgtaacaagggtgaacactatcccatatcaccagctcaccgtctttcattgccatacggaactccggatgagcattcatcaggcgggcaagaatgtgaataaaggccggataaaacttgtgcttatttttctttacggtctttaaaaaggccgtaatatccagctgaacggtctggttataggtacattgagcaactgactgaaatgcctcaaaatgttctttacgatgccattgggatatatcaacggtggtatatccagtgatttttttctccattttagcttccttagctcctgaaaatctcgataactcaaaaaatacgcccggtagtgatcttatttcattatggtgaaagttggaacctcttacgtgccaagccaaataggccgtcactcggtcgctacgctccgggcgtgagactgcggcgggcgctgcggacacatacaaagttacccacagattccgtggataagcaggggactaacatgtgaggcaaaacagcagggccgcgccggtggcgtttttccataggctccgccctcctgccagagttcacataaacagacgcttttccggtgcatctgtgggagccgtgaggctcaaccatgaatctgacagtacgggcgaaacccgacaggacttaaagatccccaccgtttccggcgggtcgctccctcttgcgctctcctgttccgaccctgccgtttaccggatacctgttccgcctttctcccttacgggaagtgtggcgctttctcatagctcacacactggtatctcggctcggtgtaggtcgttcgctccaagctgggctgtaagcaagaactccccgttcagcccgactgctgcgccttatccggtaactgttcacttgagtccaacccggaaaagcacggtaaaacgccactggcagcagccattggtaactgggagttcgcagaggatttgtttagctaaacacgcggttgctcttgaagtgtgcgccaaagtccggctacactggaaggacagatttggttgctgtgctctgcgaaagccagttaccacggttaagcagttccccaactgacttaaccttcgatcaaaccacctccccaggtggttttttcgtttacagggcaaaagattacgcgcagaaaaaaaggatctcaagaagatcctttgatcttttctactgaaccgctctagatttcagtgcaatttatctcttcaaatgtagcacctgaagtcagcccaggaggaagaggacatccggtcaaataaaacgaaaggctcagtcgaaagactgggcctttcgttttagacttagggaccctttatgacaacttgacggctacatcattcactttttcttcacaaccggcacggaactcgctcgggctggccccggtgcattttttaaatacccgcgagaaatagagttgatcgtcaaaaccaacattgcgaccgacggtggcgataggcatccgggtggtgctcaaaagcagcttcgcctggctgatacgttggtcctcgcgccagcttaagacgctaatccctaactgctggcggaaaagatgtgacagacgcgacggcgacaagcaaacatgctgtgcgacgctggcgatatcaaaattgctgtctgccaggtgatcgctgatgtactgacaagcctcgcgtacccgattatccatcggtggatggagcgactcgttaatcgcttccatgcgccgcagtaacaattgctcaagcagatttatcgccagcagctccgaatagcgcccttccccttgcccggcgttaatgatttgcccaaacaggtcgctgaaatgcggctggtgcgcttcatccgggcgaaagaaccccgtattggcaaatattgacggccagttaagccattcatgccagtaggcgcgcggacgaaagtaaacccactggtgataccattcgcgagcctccggatgacgaccgtagtgatgaatctctcctggcgggaacagcaaaatatcacccggtcggcaaacaaattctcgtccctgatttttcaccaccccctgaccgcgaatggtgagattgagaatataacctttcattcccagcggtcggtcgataaaaaaatcgagataaccgttggcctcaatcggcgttaaacccgccaccagatgggcattaaacgagtatcccggcagcaggggatcattttgcgcttcagccatacttttcatactcccaccattcagagaagaaaccaattgtccatattgcatcagacattgccgtcactgcgtcttttactggctcttctcgctaacccaaccggtaaccccgcttattaaaagcattctgtaacaaagcgggaccaaagccatgacaaaaacgcgtaacaaaagtgtctataatcacggcagaaaagtccacattgattatttgcacggcgtcacactttgctatgccatagcatttttatccataagattagcggatcctacctgacgctttttatcgcaactctctactgtttctccatacccgtttttttggacgcgtacaactcaa

SEQ ID NO: 45 - DNA, 4609 bp, Artificial Sequence
  Synthetic Polynucleotide
cactcggtcgctacgctccgggcgtgagactgcggcgggcgctgcggacacatacaaagttacccacagattccgtggataagcaggggactaacatgtgaggcaaaacagcagggccgcgccggtggcgtttttccataggctccgccctcctgccagagttcacataaacagacgcttttccggtgcatctgtgggagccgtgaggctcaaccatgaatctgacagtacgggcgaaacccgacaggacttaaagatccccaccgtttccggcgggtcgctccctcttgcgctctcctgttccgaccctgccgtttaccggatacctgttccgcctttctcccttacgggaagtgtggcgctttctcatagctcacacactggtatctcggctcggtgtaggtcgttcgctccaagctgggctgtaagcaagaactccccgttcagcccgactgctgcgccttatccggtaactgttcacttgagtccaacccggaaaagcacggtaaaacgccactggcagcagccattggtaactgggagttcgcagaggatttgtttagctaaacacgcggttgctcttgaagtgtgcgccaaagtccggctacactggaaggacagatttggttgctgtgctctgcgaaagccagttaccacggttaagcagttccccaactgacttaaccttcgatcaaaccacctccccaggtggttttttcgtttacagggcaaaagattacgcgcagaaaaaaaggatctcaagaagatcctttgatcttttctactgaaccgctctagatttcagtgcaatttatctcttcaaatgtagcacctgaagtcagcccaggaggaagaggacatccggtcaaataaaacgaaaggctcagtcgaaagactgggcctttcgttttagacttagggaccctttatgacaacttgacggctacatcattcactttttcttcacaaccggcacggaactcgctcgggctggccccggtgcattttttaaatacccgcgagaaatagagttgatcgtcaaaaccaacattgcgaccgacggtggcgataggcatccgggtggtgctcaaaagcagcttcgcctggctgatacgttggtcctcgcgccagcttaagacgctaatccctaactgctggcggaaaagatgtgacagacgcgacggcgacaagcaaacatgctgtgcgacgctggcgatatcaaaattgctgtctgccaggtgatcgctgatgtactgacaagcctcgcgtacccgattatccatcggtggatggagcgactcgttaatcgcttccatgcgccgcagtaacaattgctcaagcagatttatcgccagcagctccgaatagcgcccttccccttgcccggcgttaatgatttgcccaaacaggtcgctgaaatgcggctggtgcgcttcatccgggcgaaagaaccccgtattggcaaatattgacggccagttaagccattcatgccagtaggcgcgcggacgaaagtaaacccactggtgataccattcgcgagcctccggatgacgaccgtagtgatgaatctctcctggcgggaacagcaaaatatcacccggtcggcaaacaaattctcgtccctgatttttcaccaccccctgaccgcgaatggtgagattgagaatataacctttcattcccagcggtcggtcgataaaaaaatcgagataaccgttggcctcaatcggcgttaaacccgccaccagatgggcattaaacgagtatcccggcagcaggggatcattttgcgcttcagccatacttttcatactcccaccattcagagaagaaaccaattgtccatattgcatcagacattgccgtcactgcgtcttttactggctcttctcgctaacccaaccggtaaccccgcttattaaaagcattctgtaacaaagcgggaccaaagccatgacaaaaacgcgtaacaaaagtgtctataatcacggcagaaaagtccacattgattatttgcacggcgtcacactttgctatgccatagcatttttatccataagattagcggatcctacctgacgctttttatcgcaactctctactgtttctccatacccgtttttttggacgcgtacaactcaagtctgacataaatgaccgctatgagcactgcaattacacgccagatcgttctcgctaccgcaaccaccggtatgaaccagattggtgcgcactatgaaggccacaagatcattgagattggtgccgttgaagtggtgaaccgtcgcctgacgggcaataacttccatgtttatctcaaacccgatcggctggtggatccggaagcctttggcgtacatggtattgccgatgaatttttgctcgataagcccacgtttgccgaagtagccgatgagttcatggactatattcgcggcgcggagttggtgatccataacgcagcgttcgatatcggctttatggactacgagttttcgttgcttaagcgcgatattccgaagaccaatactttctgtaaggtcaccgatagccttgcggtggcgaggaaaatgtttcccggtaagcgcaacagcctcgatgcgttatgtgctcgctacgaaatagataacagtaaacgaacgctgcacggggcattactcgatgcccagatccttgcggaagtttatctggcgatgaccggtggtcaaacgtcgatggcttttgcgatggaaggagagacacaacagcaacaaggtgaagcaacaattcagcgcattgtacgtcaggcaagtaagttacgcgttgtttttgcgacagatgaagagattgcagctcatgaagcccgtctcgatctggtgcagaagaaaggcggaagttgcctctggcgagcataatttaatatcagtaaaccggacataacccatgaagaaaaatcgcgcttttttgaagtgggcagggggcaagtatcccctgcttgatgatattaaacggcatttgcccaagggcgaatgtctggttgagccttttgtaggtgccgggtcggtgtttctcaacaccgacttttctcgttatatccttgccgatatcaatagcgacctgatcagtctctataacattgtgaagatgcgtactgatgagtacgtacaggccgcacgcgagctgtttgttcccgaaacaaattgcgccgaggtttactatcagttccgcgaagagttcaacaaaagccaggatccgttccgtcgggcggtactgtttttatatttgaaccgctacggttacaacggcctgtgtcgttacaatctgcgcggtgagtttaacgtgccgttcggccgctacaaaaaaccctatttcccggaagcagagttgtatcacttcgctgaaaaagcgcagaatgcctttttctattgtgagtcttacgccgatagcatggcgcgcgcagatgatgcatccgtcgtctattgcgatccgccttatgcaccgctgtctgcgaccgccaactttacggcgtatcacacaaacagttttacgcttgaacaacaagcgcatctggcggagatcgccgaaggtctggttgagcgccatattccagtgctgatctccaatcacgatacgatgttaacgcgtgagtggtatcagcgcgcaaaattgcatgtcgtcaaagttcgacgcagtataagcagcaacggcggcacacgtaaaaaggtggacgaactgctggctttgtacaaaccaggagtcgtttcacccgcgaaaaaataaacttaattaacggcactcctcagccaagtcaaaagcctccgaccggaggcttttgactacatgcccatggcgtttacgccccgccctgccactcatcgcagtactgttgtaattcattaagcattctgccgacatggaagccatcacaaacggcatgatgaacctgaatcgccagcggcatcagcaccttgtcgccttgcgtataatatttgcccatagtgaaaacgggggcgaagaagttgtccatattggccacgtttaaatcaaaactggtgaaactcacccagggattggctgagacgaaaaacatattctcaataaaccctttagggaaataggccaggttttcaccgtaacacgccacatcttgcgaatatatgtgtagaaactgccggaaatcgtcgtggtattcactccagagcgatgaaaacgtttcagtttgctcatggaaaacggtgtaacaagggtgaacactatcccatatcaccagctcaccgtctttcattgccatacggaactccggatgagcattcatcaggcgggcaagaatgtgaataaaggccggataaaacttgtgcttatttttctttacggtctttaaaaaggccgtaatatccagctgaacggtctggttataggtacattgagcaactgactgaaatgcctcaaaatgttctttacgatgccattgggatatatcaacggtggtatatccagtgatttttttctccattttagcttccttagctcctgaaaatctcgataactcaaaaaatacgcccggtagtgatcttatttcattatggtgaaagttggaacctcttacgtgccaagccaaataggccgt

SEQ ID NO: 46 - DNA, 5183 bp, Artificial Sequence
  Synthetic Polynucleotide
cactcggtcgctacgctccgggcgtgagactgcggcgggcgctgcggacacatacaaagttacccacagattccgtggataagcaggggactaacatgtgaggcaaaacagcagggccgcgccggtggcgtttttccataggctccgccctcctgccagagttcacataaacagacgcttttccggtgcatctgtgggagccgtgaggctcaaccatgaatctgacagtacgggcgaaacccgacaggacttaaagatccccaccgtttccggcgggtcgctccctcttgcgctctcctgttccgaccctgccgtttaccggatacctgttccgcctttctcccttacgggaagtgtggcgctttctcatagctcacacactggtatctcggctcggtgtaggtcgttcgctccaagctgggctgtaagcaagaactccccgttcagcccgactgctgcgccttatccggtaactgttcacttgagtccaacccggaaaagcacggtaaaacgccactggcagcagccattggtaactgggagttcgcagaggatttgtttagctaaacacgcggttgctcttgaagtgtgcgccaaagtccggctacactggaaggacagatttggttgctgtgctctgcgaaagccagttaccacggttaagcagttccccaactgacttaaccttcgatcaaaccacctccccaggtggttttttcgtttacagggcaaaagattacgcgcagaaaaaaaggatctcaagaagatcctttgatcttttctactgaaccgctctagatttcagtgcaatttatctcttcaaatgtagcacctgaagtcagcccaggaggaagaggacatccggtcaaataaaacgaaaggctcagtcgaaagactgggcctttcgttttagacttagggaccctttatgacaacttgacggctacatcattcactttttcttcacaaccggcacggaactcgctcgggctggccccggtgcattttttaaatacccgcgagaaatagagttgatcgtcaaaaccaacattgcgaccgacggtggcgataggcatccgggtggtgctcaaaagcagcttcgcctggctgatacgttggtcctcgcgccagcttaagacgctaatccctaactgctggcggaaaagatgtgacagacgcgacggcgacaagcaaacatgctgtgcgacgctggcgatatcaaaattgctgtctgccaggtgatcgctgatgtactgacaagcctcgcgtacccgattatccatcggtggatggagcgactcgttaatcgcttccatgcgccgcagtaacaattgctcaagcagatttatcgccagcagctccgaatagcgcccttccccttgcccggcgttaatgatttgcccaaacaggtcgctgaaatgcggctggtgcgcttcatccgggcgaaagaaccccgtattggcaaatattgacggccagttaagccattcatgccagtaggcgcgcggacgaaagtaaacccactggtgataccattcgcgagcctccggatgacgaccgtagtgatgaatctctcctggcgggaacagcaaaatatcacccggtcggcaaacaaattctcgtccctgatttttcaccaccccctgaccgcgaatggtgagattgagaatataacctttcattcccagcggtcggtcgataaaaaaatcgagataaccgttggcctcaatcggcgttaaacccgccaccagatgggcattaaacgagtatcccggcagcaggggatcattttgcgcttcagccatacttttcatactcccaccattcagagaagaaaccaattgtccatattgcatcagacattgccgtcactgcgtcttttactggctcttctcgctaacccaaccggtaaccccgcttattaaaagcattctgtaacaaagcgggaccaaagccatgacaaaaacgcgtaacaaaagtgtctataatcacggcagaaaagtccacattgattatttgcacggcgtcacactttgctatgccatagcatttttatccataagattagcggatcctacctgacgctttttatcgcaactctctactgtttctccatacccgtttttttggacgcgtacaactcaagtctgacataaatgaccgctatgagcactgcaattacacgccagatcgttctcgctaccgcaaccaccggtatgaaccagattggtgcgcactatgaaggccacaagatcattgagattggtgccgttgaagtggtgaaccgtcgcctgacgggcaataacttccatgtttatctcaaacccgatcggctggtggatccggaagcctttggcgtacatggtattgccgatgaatttttgctcgataagcccacgtttgccgaagtagccgatgagttcatggactatattcgcggcgcggagttggtgatccataacgcagcgttcgatatcggctttatggactacgagttttcgttgcttaagcgcgatattccgaagaccaatactttctgtaaggtcaccgatagccttgcggtggcgaggaaaatgtttcccggtaagcgcaacagcctcgatgcgttatgtgctcgctacgaaatagataacagtaaacgaacgctgcacggggcattactcgatgcccagatccttgcggaagtttatctggcgatgaccggtggtcaaacgtcgatggcttttgcgatggaaggagagacacaacagcaacaaggtgaagcaacaattcagcgcattgtacgtcaggcaagtaagttacgcgttgtttttgcgacagatgaagagattgcagctcatgaagcccgtctcgatctggtgcagaagaaaggcggaagttgcctctggcgagcataatttaatatcagtaaaccggacataacccatgaagaaaaatcgcgcttttttgaagtgggcagggggcaagtatcccctgcttgatgatattaaacggcatttgcccaagggcgaatgtctggttgagccttttgtaggtgccgggtcggtgtttctcaacaccgacttttctcgttatatccttgccgatatcaatagcgacctgatcagtctctataacattgtgaagatgcgtactgatgagtacgtacaggccgcacgcgagctgtttgttcccgaaacaaattgcgccgaggtttactatcagttccgcgaagagttcaacaaaagccaggatccgttccgtcgggcggtactgtttttatatttgaaccgctacggttacaacggcctgtgtcgttacaatctgcgcggtgagtttaacgtgccgttcggccgctacaaaaaaccctatttcccggaagcagagttgtatcacttcgctgaaaaagcgcagaatgcctttttctattgtgagtcttacgccgatagcatggcgcgcgcagatgatgcatccgtcgtctattgcgatccgccttatgcaccgctgtctgcgaccgccaactttacggcgtatcacacaaacagttttacgcttgaacaacaagcgcatctggcggagatcgccgaaggtctggttgagcgccatattccagtgctgatctccaatcacgatacgatgttaacgcgtgagtggtatcagcgcgcaaaattgcatgtcgtcaaagttcgacgcagtataagcagcaacggcggcacacgtaaaaaggtggacgaactgctggctttgtacaaaccaggagtcgtttcacccgcgaaaaaataattcagctaagacactgcactggattaagatgaaaacgattgaagttgatgatgaactctacagctatattgccagccacactaagcatatcggcgagagcgcatccgacattttacggcgtatgttgaaattttccgccgcatcacagcctgctgctccggtgacgaaagaggttcgcgttgcgtcacctgctatcgtcgaagcgaagccggtcaaaacgattaaagacaaggttcgcgcaatgcgtgaacttctgctttcggatgaatacgcagagcaaaagcgagcggtcaatcgctttatgctgctgttgtctacactatattctcttgacgcccaggcgtttgccgaagcaacggaatcgttgcacggtcgtacacgcgtttactttgcggcagatgaacaaacgctgctgaaaaatggtaatcagaccaagccgaaacatgtgccaggcacgccgtattgggtgatcaccaacaccaacaccggccgtaaatgcagcatgatcgaacacatcatgcagtcgatgcaattcccggcggaattgattgagaaggtttgcggaactatctaaacttaattaacggcactcctcagccaagtcaaaagcctccgaccggaggcttttgactacatgcccatggcgtttacgccccgccctgccactcatcgcagtactgttgtaattcattaagcattctgccgacatggaagccatcacaaacggcatgatgaacctgaatcgccagcggcatcagcaccttgtcgccttgcgtataatatttgcccatagtgaaaacgggggcgaagaagttgtccatattggccacgtttaaatcaaaactggtgaaactcacccagggattggctgagacgaaaaacatattctcaataaaccctttagggaaataggccaggttttcaccgtaacacgccacatcttgcgaatatatgtgtagaaactgccggaaatcgtcgtggtattcactccagagcgatgaaaacgtttcagtttgctcatggaaaacggtgtaacaagggtgaacactatcccatatcaccagctcaccgtctttcattgccatacggaactccggatgagcattcatcaggcgggcaagaatgtgaataaaggccggataaaacttgtgcttatttttctttacggtctttaaaaaggccgtaatatccagctgaacggtctggttataggtacattgagtaactgactgaaatgcctcaaaatgttctttacgatgccattgggatatatcaacggtggtatatccagtgatttttttctccattttagcttccttagctcctgaaaatctcgataactcaaaaaatacgcccggtagtgatcttatttcattatggtgaaagttggaacctcttacgtgccaagccaaataggccgt

SEQ ID NO: 47 - DNA, 6122 bp, Artificial Sequence
  Synthetic Polynucleotide
cactcggtcgctacgctccgggcgtgagactgcggcgggcgctgcggacacatacaaagttacccacagattccgtggataagcaggggactaacatgtgaggcaaaacagcagggccgcgccggtggcgtttttccataggctccgccctcctgccagagttcacataaacagacgcttttccggtgcatctgtgggagccgtgaggctcaaccatgaatctgacagtacgggcgaaacccgacaggacttaaagatccccaccgtttccggcgggtcgctccctcttgcgctctcctgttccgaccctgccgtttaccggatacctgttccgcctttctcccttacgggaagtgtggcgctttctcatagctcacacactggtatctcggctcggtgtaggtcgttcgctccaagctgggctgtaagcaagaactccccgttcagcccgactgctgcgccttatccggtaactgttcacttgagtccaacccggaaaagcacggtaaaacgccactggcagcagccattggtaactgggagttcgcagaggatttgtttagctaaacacgcggttgctcttgaagtgtgcgccaaagtccggctacactggaaggacagatttggttgctgtgctctgcgaaagccagttaccacggttaagcagttccccaactgacttaaccttcgatcaaaccacctccccaggtggttttttcgtttacagggcaaaagattacgcgcagaaaaaaaggatctcaagaagatcctttgatcttttctactgaaccgctctagatttcagtgcaatttatctcttcaaatgtagcacctgaagtcagcccaggaggaagaggacatccggtcaaataaaacgaaaggctcagtcgaaagactgggcctttcgttttagacttagggaccctttatgacaacttgacggctacatcattcactttttcttcacaaccggcacggaactcgctcgggctggccccggtgcattttttaaatacccgcgagaaatagagttgatcgtcaaaaccaacattgcgaccgacggtggcgataggcatccgggtggtgctcaaaagcagcttcgcctggctgatacgttggtcctcgcgccagcttaagacgctaatccctaactgctggcggaaaagatgtgacagacgcgacggcgacaagcaaacatgctgtgcgacgctggcgatatcaaaattgctgtctgccaggtgatcgctgatgtactgacaagcctcgcgtacccgattatccatcggtggatggagcgactcgttaatcgcttccatgcgccgcagtaacaattgctcaagcagatttatcgccagcagctccgaatagcgcccttccccttgcccggcgttaatgatttgcccaaacaggtcgctgaaatgcggctggtgcgcttcatccgggcgaaagaaccccgtattggcaaatattgacggccagttaagccattcatgccagtaggcgcgcggacgaaagtaaacccactggtgataccattcgcgagcctccggatgacgaccgtagtgatgaatctctcctggcgggaacagcaaaatatcacccggtcggcaaacaaattctcgtccctgatttttcaccaccccctgaccgcgaatggtgagattgagaatataacctttcattcccagcggtcggtcgataaaaaaatcgagataaccgttggcctcaatcggcgttaaacccgccaccagatgggcattaaacgagtatcccggcagcaggggatcattttgcgcttcagccatacttttcatactcccaccattcagagaagaaaccaattgtccatattgcatcagacattgccgtcactgcgtcttttactggctcttctcgctaacccaaccggtaaccccgcttattaaaagcattctgtaacaaagcgggaccaaagccatgacaaaaacgcgtaacaaaagtgtctataatcacggcagaaaagtccacattgattatttgcacggcgtcacactttgctatgccatagcatttttatccataagattagcggatcctacctgacgctttttatcgcaactctctactgtttctccatacccgtttttttggacgcgtacaactcaagtctgacataaatgaccgctatgagcactgcaattacacgccagatcgttctcgctaccgcaaccaccggtatgaaccagattggtgcgcactatgaaggccacaagatcattgagattggtgccgttgaagtggtgaaccgtcgcctgacgggcaataacttccatgtttatctcaaacccgatcggctggtggatccggaagcctttggcgtacatggtattgccgatgaatttttgctcgataagcccacgtttgccgaagtagccgatgagttcatggactatattcgcggcgcggagttggtgatccataacgcagcgttcgatatcggctttatggactacgagttttcgttgcttaagcgcgatattccgaagaccaatactttctgtaaggtcaccgatagccttgcggtggcgaggaaaatgtttcccggtaagcgcaacagcctcgatgcgttatgtgctcgctacgaaatagataacagtaaacgaacgctgcacggggcattactcgatgcccagatccttgcggaagtttatctggcgatgaccggtggtcaaacgtcgatggcttttgcgatggaaggagagacacaacagcaacaaggtgaagcaacaattcagcgcattgtacgtcaggcaagtaagttacgcgttgtttttgcgacagatgaagagattgcagctcatgaagcccgtctcgatctggtgcagaagaaaggcggaagttgcctctggcgagcataatttaatatcagtaaaccggacataacccatgaagaaaaatcgcgcttttttgaagtgggcagggggcaagtatcccctgcttgatgatattaaacggcatttgcccaagggcgaatgtctggttgagccttttgtaggtgccgggtcggtgtttctcaacaccgacttttctcgttatatccttgccgatatcaatagcgacctgatcagtctctataacattgtgaagatgcgtactgatgagtacgtacaggccgcacgcgagctgtttgttcccgaaacaaattgcgccgaggtttactatcagttccgcgaagagttcaacaaaagccaggatccgttccgtcgggcggtactgtttttatatttgaaccgctacggttacaacggcctgtgtcgttacaatctgcgcggtgagtttaacgtgccgttcggccgctacaaaaaaccctatttcccggaagcagagttgtatcacttcgctgaaaaagcgcagaatgcctttttctattgtgagtcttacgccgatagcatggcgcgcgcagatgatgcatccgtcgtctattgcgatccgccttatgcaccgctgtctgcgaccgccaactttacggcgtatcacacaaacagttttacgcttgaacaacaagcgcatctggcggagatcgccgaaggtctggttgagcgccatattccagtgctgatctccaatcacgatacgatgttaacgcgtgagtggtatcagcgcgcaaaattgcatgtcgtcaaagttcgacgcagtataagcagcaacggcggcacacgtaaaaaggtggacgaactgctggctttgtacaaaccaggagtcgtttcacccgcgaaaaaataattcagctaagacactgcactggattaagatgaaaacgattgaagttgatgatgaactctacagctatattgccagccacactaagcatatcggcgagagcgcatccgacattttacggcgtatgttgaaattttccgccgcatcacagcctgctgctccggtgacgaaagaggttcgcgttgcgtcacctgctatcgtcgaagcgaagccggtcaaaacgattaaagacaaggttcgcgcaatgcgtgaacttctgctttcggatgaatacgcagagcaaaagcgagcggtcaatcgctttatgctgctgttgtctacactatattctcttgacgcccaggcgtttgccgaagcaacggaatcgttgcacggtcgtacacgcgtttactttgcggcagatgaacaaacgctgctgaaaaatggtaatcagaccaagccgaaacatgtgccaggcacgccgtattgggtgatcaccaacaccaacaccggccgtaaatgcagcatgatcgaacacatcatgcagtcgatgcaattcccggcggaattgattgagaaggtttgcggaactatctaataatacaaaaattaggaggaatttcaacatgacaaatttatctgacatcattgaaaaagaaacaggaaaacaactagtgattcaagaatcaattctaatgttaccagaagaagtagaggaagtaattgggaataaaccagaaagtgatattttagttcatactgcttatgatgaaagtacagatgaaaatgtaatgctattaacttcagatgctccagaatataaaccttgggctttagtaattcaagacagtaatggagaaaataaaattaaaatgttataagtcgagattaagtaaaccggaatctgaagatgaccgacgcggaatacgttcgtatccacgaaaaactggacatctacaccttcaaaaaacagttcttcaacaacaaaaaatctgtttctcaccgttgctacgttctgttcgaactgaaacgtcgtggtgaacgtcgtgcgtgcttctggggttacgcggttaacaaaccgcagtctggtaccgaacgtggtatccacgcggaaatcttctctatccgtaaagttgaagaatacctgcgtgacaacccgggtcagttcaccatcaactggtactcttcttggtctccgtgcgcggactgcgcggaaaaaatcctggaatggtacaaccaggaactgcgtggtaacggtcacaccctgaaaatctgggcgtgcaaactgtactacgaaaaaaacgcgcgtaaccagatcggtctgtggaacctgcgtgacaacggtgttggtctgaacgttatggtttctgaacactaccagtgctgccgtaaaatcttcatccagtcttctcacaaccagctgaacgaaaaccgttggctggaaaaaaccctgaaacgtgcggaaaaacgtcgttctgaactgtctatcatgatccaggttaaaatcctgcacaccaccaaatctccggcggtttaaacttaattaacggcactcctcagccaagtcaaaagcctccggtcggaggcttttgactacatgcccatggcgtttacgccccgccctgccactcatcgcagtactgttgtaattcattaagcattctgccgacatggaagccatcacaaacggcatgatgaacctgaatcgccagcggcatcagcaccttgtcgccttgcgtataatatttgcccatagtgaaaacgggggcgaagaagttgtccatattggccacgtttaaatcaaaactggtgaaactcacccagggattggctgagacgaaaaacatattctcaataaaccctttagggaaataggccaggttttcaccgtaacacgccacatcttgcgaatatatgtgtagaaactgccggaaatcgtcgtggtattcactccagagcgatgaaaacgtttcagtttgctcatggaaaacggtgtaacaagggtgaacactatcccatatcaccagctcaccgtctttcattgccatacggaactccggatgagcattcatcaggcgggcaagaatgtgaataaaggccggataaaacttgtgcttatttttctttacggtctttaaaaaggccgtaatatccagctgaacggtctggttataggtacattgagtaactgactgaaatgcctcaaaatgttctttacgatgccattgggatatatcaacggtggtatatccagtgatttttttctccattttagcttccttagctcctgaaaatctcgataactcaaaaaatacgcccggtagtgatcttatttcattatggtgaaagttggaacctcttacgtgccaagccaaataggccgt

SEQ ID NO: 48 - DNA, 6681 bp, Artificial Sequence; identical to SEQ ID NO: 26
  Synthetic Polynucleotide

SEQ ID NO: 49 - DNA, 6495 bp, Artificial Sequence
  Synthetic Polynucleotide
gtctgacataaatgaccgctatgtctgaaccacgtttcgtacacctgcgggtgcacagcgactactcgatgatcgatggcctggccaaaaccgcaccgttggtaaaaaaggcggcggcgttgggtatgccagcactggcgatcaccgatttcaccaacctttgtggtctggtgaagttctacggagcgggacatggcgcagggattaagcctatcgtcggggcagattttaacgtccagtgcgacctgctgggtgatgagttaacccacctgacggtactggcggcgaacaataccggctatcagaatctgacgttgctgatctcaaaagcgtatcagcgcgggtacggtgccgccgggccgatcatcgatcgcgactggcttatcgaattaaacgaagggttgatccttctttccggccgtcgcatgggcgacgtcggacgcagtcttttgcgtggtaacagcgcgctggtagatgagtgtgtcgcgttttatgaagaacacttcccggatcgctattttctcgagctgatccgcaccggcaggccggatgaagaaagctatctgcacgcggcggtggaactggcggaagcgcgcggtttgcccgtcgtggcgaccaacgacgtgcgctttatcgacagcagcgactttgacgcacacgaaatccgcgtcgcgatccacgacggctttaccctcgacgatcctaaacgcccgcgtaactattcgccgcagcaatatatgcgtagcgaagaggagatgtgtgagctgtttgccgacatccccgaagcccttgccaacaccgttgagatcgccaaacgctgtaacgtaaccgtgcgtcttggtgaatacttcctgccgcagttcccgaccggggacatgagcaccgaagattatctggtcaagcgtgcaaaagagggcctggaagagcgtctggcctttttattccctgatgaggaagaacgtcttaagcgccgcccggaatatgacgaacgtctggagactgaacttcaggttatcaaccagatgggcttcccgggctacttcctcatcgttatggaatttatccagtggtcgaaagataacggcgtaccggtagggccaggccgtggctccggtgcgggttcactggtggcctacgcgctgaaaatcaccgacctcgatccgctggaatttgacctgctgttcgaacgtttccttaacccggaacgtgtctccatgcctgacttcgacgttgacttctgtatggagaaacgcgatcaggttatcgagcacgtagcggacatgtacggtcgtgatgcggtatcgcagatcatcaccttcggtacaatggcggcgaaagcggtgatccgcgacgtaggccgcgtgctggggcatccgtacggctttgtcgatcgtatctcgaaactgatcccgcccgatccggggatgacgctggcgaaagcgtttgaagccgagccgcagctgccggaaatctacgaagcggatgaagaagttaaggcgctgatcgacatggcgcgcaaactggaaggggtcacccgtaacgccggtaagcacgccggtggggtggttatcgcgccgaccaaaattaccgattttgcgccgctttactgcgatgaagagggcaaacatccggtcacccagtttgataaaagcgacgttgaatacgccggactggtgaagttcgacttccttggtttgcgtacgctcaccatcatcaactgggcgctggagatgatcaacaagcggcgggcgaagaatggcgagccgccgctggatatcgctgcgatcccgctggatgataagaaaagcttcgacatgctgcaacgctcggaaaccacggcggtattccagcttgaatcgcgcggcatgaaggacctgatcaagcgtctacaacctgactgcttcgaagatatgatcgccctagtggcactgttccgccccggtccgttgcaatcagggatggtggataactttatcgaccgtaaacatggtcgtgaagagatctcctatccggacgtacagtggcagcatgaaagcctgaaaccggtactggagccaacctacggcattatcctgtatcaggaacaggtcatgcagattgcgcaggtgctttctggttataccctcggtggcgcggatatgctgcgtcgtgcgatgggtaagaaaaagccggaagagatggctaagcaacgttctgtatttgctgaaggtgcagaaaagaacggaatcaacgctgaactggcgatgaaaatcttcgacctggtggagaaattcgctggttacggatttaacaaatcgcactctgcggcctatgctttggtgtcatatcaaacgttatggctgaaagcgcactatcctgcggagtttatggcggcggtaatgaccgccgatatggacaacaccgagaaggtggtgggtctggtggatgagtgctggcggatggggctgaaaatcctgccaccagatataaactccggtctttaccatttccacgtcaacgacgacggcgaaatcgtgtatggtattggcgcgatcaaaggggtcggtgaaggtccgattgaggccatcatcgaagcccgtaataaaggcggctacttccgcgaactgtttgatctctgcgcccgtaccgacaccaaaaagttgaaccgtcgcgtgctggaaaaactgatcatgtccggggcgtttgaccgtcttgggccacatcgcgcagcgctgatgaactcgctgggcgatgcgttaaaagcggcagatcaacacgcgaaagcggaagctatcggtcaggccgatatgttcggcgtgctggccgaagagccggaacaaattgaacaatcctacgccagctgccaaccgtggccggagcaggtggtattagatggggaacgtgaaacgttaggcctgtacctgaccggacaccctatcaaccagtatttaaaagagattgagcgttatgtcggaggcgtaaggctgaaagacatgcacccgacagaacgtggtaaagtcatcacggctgcggggctcgttgttgccgcgcgggttatggtcaccaagcgcggcaatcgtatcggtatctgcacgctggatgaccgttccgggcggctggaagtgatgttgtttactgacgccctggataaataccagcaattgctggaaaaagaccgcatacttatcgtcagcggacaggtcagctttgatgacttcagcggtgggcttaaaatgaccgctcgcgaagtgatggatattgacgaagcccgggaaaaatatgctcgcgggcttgctatctcgctgacggacaggcaaattgatgaccagcttttaaaccgactccgtcagtctctggaaccccaccgctctgggacaattccagtacatctctactatcagagggcggatgcacgcgcgcggttgcgttttggcgcgacgtggcgtgtctctccgagcgatcgtttattaaacgatctccgtggcctcattggttcggagcaggtggaactggagtttgactaaacttaattaacggcactcctcagccaagtcaaaagcctccgaccggaggcttttgactacatgcccatggcgtttacgccccgccctgccactcatcgcagtactgttgtaattcattaagcattctgccgacatggaagccatcacaaacggcatgatgaacctgaatcgccagcggcatcagcaccttgtcgccttgcgtataatatttgcccatagtgaaaacgggggcgaagaagttgtccatattggccacgtttaaatcaaaactggtgaaactcacccagggattggctgagacgaaaaacatattctcaataaaccctttagggaaataggccaggttttcaccgtaacacgccacatcttgcgaatatatgtgtagaaactgccggaaatcgtcgtggtattcactccagagcgatgaaaacgtttcagtttgctcatggaaaacggtgtaacaagggtgaacactatcccatatcaccagctcaccgtctttcattgccatacggaactccggatgagcattcatcaggcgggcaagaatgtgaataaaggccggataaaacttgtgcttatttttctttacggtctttaaaaaggccgtaatatccagctgaacggtctggttataggtacattgagcaactgactgaaatgcctcaaaatgttctttacgatgccattgggatatatcaacggtggtatatccagtgatttttttctccattttagcttccttagctcctgaaaatctcgataactcaaaaaatacgcccggtagtgatcttatttcattatggtgaaagttggaacctcttacgtgccaagccaaataggccgtcactcggtcgctacgctccgggcgtgagactgcggcgggcgctgcggacacatacaaagttacccacagattccgtggataagcaggggactaacatgtgaggcaaaacagcagggccgcgccggtggcgtttttccataggctccgccctcctgccagagttcacataaacagacgcttttccggtgcatctgtgggagccgtgaggctcaaccatgaatctgacagtacgggcgaaacccgacaggacttaaagatccccaccgtttccggcgggtcgctccctcttgcgctctcctgttccgaccctgccgtttaccggatacctgttccgcctttctcccttacgggaagtgtggcgctttctcatagctcacacactggtatctcggctcggtgtaggtcgttcgctccaagctgggctgtaagcaagaactccccgttcagcccgactgctgcgccttatccggtaactgttcacttgagtccaacccggaaaagcacggtaaaacgccactggcagcagccattggtaactgggagttcgcagaggatttgtttagctaaacacgcggttgctcttgaagtgtgcgccaaagtccggctacactggaaggacagatttggttgctgtgctctgcgaaagccagttaccacggttaagcagttccccaactgacttaaccttcgatcaaaccacctccccaggtggttttttcgtttacagggcaaaagattacgcgcagaaaaaaaggatctcaagaagatcctttgatcttttctactgaaccgctctagatttcagtgcaatttatctcttcaaatgtagcacctgaagtcagcccaggaggaagaggacatccggtcaaataaaacgaaaggctcagtcgaaagactgggcctttcgttttagacttagggaccctttatgacaacttgacggctacatcattcactttttcttcacaaccggcacggaactcgctcgggctggccccggtgcattttttaaatacccgcgagaaatagagttgatcgtcaaaaccaacattgcgaccgacggtggcgataggcatccgggtggtgctcaaaagcagcttcgcctggctgatacgttggtcctcgcgccagcttaagacgctaatccctaactgctggcggaaaagatgtgacagacgcgacggcgacaagcaaacatgctgtgcgacgctggcgatatcaaaattgctgtctgccaggtgatcgctgatgtactgacaagcctcgcgtacccgattatccatcggtggatggagcgactcgttaatcgcttccatgcgccgcagtaacaattgctcaagcagatttatcgccagcagctccgaatagcgcccttccccttgcccggcgttaatgatttgcccaaacaggtcgctgaaatgcggctggtgcgcttcatccgggcgaaagaaccccgtattggcaaatattgacggccagttaagccattcatgccagtaggcgcgcggacgaaagtaaacccactggtgataccattcgcgagcctccggatgacgaccgtagtgatgaatctctcctggcgggaacagcaaaatatcacccggtcggcaaacaaattctcgtccctgatttttcaccaccccctgaccgcgaatggtgagattgagaatataacctttcattcccagcggtcggtcgataaaaaaatcgagataaccgttggcctcaatcggcgttaaacccgccaccagatgggcattaaacgagtatcccggcagcaggggatcattttgcgcttcagccatacttttcatactcccaccattcagagaagaaaccaattgtccatattgcatcagacattgccgtcactgcgtcttttactggctcttctcgctaacccaaccggtaaccccgcttattaaaagcattctgtaacaaagcgggaccaaagccatgacaaaaacgcgtaacaaaagtgtctataatcacggcagaaaagtccacattgattatttgcacggcgtcacactttgctatgccatagcatttttatccataagattagcggatcctacctgacgctttttatcgcaactctctactgtttctccatacccgtttttttggacgcgtacaactcaa

SEQ ID NO: 50 - DNA, 6495 bp, Artificial Sequence
  Synthetic Polynucleotide
gtctgacataaatgaccgctatgtctgaaccacgtttcgtacacctgcgggtgcacagcgactactcgatgatcgatggcctggccaaaaccgcaccgttggtaaaaaaggcggcggcgttgggtatgccagcactggcgatcaccgatttcaccaacctttgtggtctggtgaagttctacggagcgggacatggcgcagggattaagcctatcgtcggggcagattttaacgtccagtgcgacctgctgggtgatgagttaacccacctgacggtactggcggcgaacaataccggctatcagaatctgacgttgctgatctcaaaagcgtatcagcgcgggtacggtgccgccgggccgatcatcgatcgcgactggcttatcgaattaaacgaagggttgatccttctttccggcggacgcatgggcgacgtcggacgcagtcttttgcgtggtaacagcgcgctggtagatgagtgtgtcgcgttttatgaagaacacttcccggatcgctattttctcgagctgatccgcaccggcaggccggatgaagaaagctatctgcacgcggcggtggaactggcggaagcgcgcggtttgcccgtcgtggcgaccaacgacgtgcgctttatcgacagcagcgactttgacgcacacgaaatccgcgtcgcgatccacgacggctttaccctcgacgatcctaaacgcccgcgtaactattcgccgcagcaatatatgcgtagcgaagaggagatgtgtgagctgtttgccgacatccccgaagcccttgccaacaccgttgagatcgccaaacgctgtaacgtaaccgtgcgtcttggtgaatacttcctgccgcagttcccgaccggggacatgagcaccgaagattatctggtcaagcgtgcaaaagagggcctggaagagcgtctggcctttttattccctgatgaggaagaacgtcttaagcgccgcccggaatatgacgaacgtctggagactgaacttcaggttatcaaccagatgggcttcccgggctacttcctcatcgttatggaatttatccagtggtcgaaagataacggcgtaccggtagggccaggccgtggctccggtgcgggttcactggtggcctacgcgctgaaaatcaccgacctcgatccgctggaatttgacctgctgttcgaacgtttccttaacccggaacgtgtctccatgcctgacttcgacgttgacttctgtatggagaaacgcgatcaggttatcgagcacgtagcggacatgtacggtcgtgatgcggtatcgcagatcatcaccttcggtacaatggcggcgaaagcggtgatccgcgacgtaggccgcgtgctggggcatccgtacggctttgtcgatcgtatctcgaaactgatcccgcccgatccggggatgacgctggcgaaagcgtttgaagccgagccgcagctgccggaaatctacgaagcggatgaagaagttaaggcgctgatcgacatggcgcgcaaactggaaggggtcacccgtaacgccggtaagcacgccggtggggtggttatcgcgccgaccaaaattaccgattttgcgccgctttactgcgatgaagagggcaaacatccggtcacccagtttgataaaagcgacgttgaatacgccggactggtgaagttcgacttccttggtttgcgtacgctcaccatcatcaactgggcgctggagatgatcaacaagcggcgggcgaagaatggcgagccgccgctggatatcgctgcgatcccgctggatgataagaaaagcttcgacatgctgcaacgctcggaaaccacggcggtattccagcttgaatcgcgcggcatgaaggacctgatcaagcgtctacaacctgactgcttcgaagatatgatcgccctagtggcactgttccgccccggtccgttgcaatcagggatggtggataactttatcgaccgtaaacatggtcgtgaagagatctcctatccggacgtacagtggcagcatgaaagcctgaaaccggtactggagccaacctacggcattatcctgtatcaggaacaggtcatgcagattgcgcaggtgctttctggttataccctcggtggcgcggatatgctgcgtcgtgcgatgggtaagaaaaagccggaagagatggctaagcaacgttctgtatttgctgaaggtgcagaaaagaacggaatcaacgctgaactggcgatgaaaatcttcgacctggtggagaaattcgctggttacggatttaacaaatcgcactctgcggcctatgctttggtgtcatatcaaacgttatggctgaaagcgcactatcctgcggagtttatggcggcggtaatgaccgccgatatggacaacaccgagaaggtggtgggtctggtggatgagtgctggcggatggggctgaaaatcctgccaccagatataaactccggtctttaccatttccacgtcaacgacgacggcgaaatcgtgtatggtattggcgcgatcaaaggggtcggtgaaggtccgattgaggccatcatcgaagcccgtaataaaggcggctacttccgcgaactgtttgatctctgcgcccgtaccgacaccaaaaagttgaaccgtcgcgtgctggaaaaactgatcatgccgggggcgtttgaccgtcttgggccacatcgcgcagcgctgatgaactcgctgggcgatgcgttaaaagcggcagatcaacacgcgaaagcggaagctatcggtcaggccgatatgttcggcgtgctggccgaagagccggaacaaattgaacaatcctacgccagctgccaaccgtggccggagcaggtggtattagatggggaacgtgaaacgttaggcctgtacctgaccggacaccctatcaaccagtatttaaaagagattgagcgttatgtcggaggcgtaaggctgaaagacatgcacccgacagaacgtggtaaagtcatcacggctgcggggctcgttgttgccgcgcgggttatggtcaccaagcgcggcaatcgtatcggtatctgcacgctggatgaccgttccgggcggctggaagtgatgttgtttactgacgccctggataaataccagcaattgctggaaaaagaccgcatacttatcgtcagcggacaggtcagctttgatgacttcagcggtgggcttaaaatgaccgctcgcgaagtgatggatattgacgaagcccgggaaaaatatgctcgcgggcttgctatctcgctgacggacaggcaaattgatgaccagcttttaaaccgactccgtcagtctctggaaccccaccgctctgggacaattccagtacatctctactatcagagggcggatgcacgcgcgcggttgcgttttggcgcgacgtggcgtgtctctccgagcgatcgtttattaaacgatctccgtggcctcattggttcggagcaggtggaactggagtttgactaaacttaattaacggcactcctcagccaagtcaaaagcctccgaccggaggcttttgactacatgcccatggcgtttacgccccgccctgccactcatcgcagtactgttgtaattcattaagcattctgccgacatggaagccatcacaaacggcatgatgaacctgaatcgccagcggcatcagcaccttgtcgccttgcgtataatatttgcccatagtgaaaacgggggcgaagaagttgtccatattggccacgtttaaatcaaaactggtgaaactcacccagggattggctgagacgaaaaacatattctcaataaaccctttagggaaataggccaggttttcaccgtaacacgccacatcttgcgaatatatgtgtagaaactgccggaaatcgtcgtggtattcactccagagcgatgaaaacgtttcagtttgctcatggaaaacggtgtaacaagggtgaacactatcccatatcaccagctcaccgtctttcattgccatacggaactccggatgagcattcatcaggcgggcaagaatgtgaataaaggccggataaaacttgtgcttatttttctttacggtctttaaaaaggccgtaatatccagctgaacggtctggttataggtacattgagcaactgactgaaatgcctcaaaatgttctttacgatgccattgggatatatcaacggtggtatatccagtgatttttttctccattttagcttccttagctcctgaaaatctcgataactcaaaaaatacgcccggtagtgatcttatttcattatggtgaaagttggaacctcttacgtgccaagccaaataggccgtcactcggtcgctacgctccgggcgtgagactgcggcgggcgctgcggacacatacaaagttacccacagattccgtggataagcaggggactaacatgtgaggcaaaacagcagggccgcgccggtggcgtttttccataggctccgccctcctgccagagttcacataaacagacgcttttccggtgcatctgtgggagccgtgaggctcaaccatgaatctgacagtacgggcgaaacccgacaggacttaaagatccccaccgtttccggcgggtcgctccctcttgcgctctcctgttccgaccctgccgtttaccggatacctgttccgcctttctcccttacgggaagtgtggcgctttctcatagctcacacactggtatctcggctcggtgtaggtcgttcgctccaagctgggctgtaagcaagaactccccgttcagcccgactgctgcgccttatccggtaactgttcacttgagtccaacccggaaaagcacggtaaaacgccactggcagcagccattggtaactgggagttcgcagaggatttgtttagctaaacacgcggttgctcttgaagtgtgcgccaaagtccggctacactggaaggacagatttggttgctgtgctctgcgaaagccagttaccacggttaagcagttccccaactgacttaaccttcgatcaaaccacctccccaggtggttttttcgtttacagggcaaaagattacgcgcagaaaaaaaggatctcaagaagatcctttgatcttttctactgaaccgctctagatttcagtgcaatttatctcttcaaatgtagcacctgaagtcagcccaggaggaagaggacatccggtcaaataaaacgaaaggctcagtcgaaagactgggcctttcgttttagacttagggaccctttatgacaacttgacggctacatcattcactttttcttcacaaccggcacggaactcgctcgggctggccccggtgcattttttaaatacccgcgagaaatagagttgatcgtcaaaaccaacattgcgaccgacggtggcgataggcatccgggtggtgctcaaaagcagcttcgcctggctgatacgttggtcctcgcgccagcttaagacgctaatccctaactgctggcggaaaagatgtgacagacgcgacggcgacaagcaaacatgctgtgcgacgctggcgatatcaaaattgctgtctgccaggtgatcgctgatgtactgacaagcctcgcgtacccgattatccatcggtggatggagcgactcgttaatcgcttccatgcgccgcagtaacaattgctcaagcagatttatcgccagcagctccgaatagcgcccttccccttgcccggcgttaatgatttgcccaaacaggtcgctgaaatgcggctggtgcgcttcatccgggcgaaagaaccccgtattggcaaatattgacggccagttaagccattcatgccagtaggcgcgcggacgaaagtaaacccactggtgataccattcgcgagcctccggatgacgaccgtagtgatgaatctctcctggcgggaacagcaaaatatcacccggtcggcaaacaaattctcgtccctgatttttcaccaccccctgaccgcgaatggtgagattgagaatataacctttcattcccagcggtcggtcgataaaaaaatcgagataaccgttggcctcaatcggcgttaaacccgccaccagatgggcattaaacgagtatcccggcagcaggggatcattttgcgcttcagccatacttttcatactcccaccattcagagaagaaaccaattgtccatattgcatcagacattgccgtcactgcgtcttttactggctcttctcgctaacccaaccggtaaccccgcttattaaaagcattctgtaacaaagcgggaccaaagccatgacaaaaacgcgtaacaaaagtgtctataatcacggcagaaaagtccacattgattatttgcacggcgtcacactttgctatgccatagcatttttatccataagattagcggatcctacctgacgctttttatcgcaactctctactgtttctccatacccgtttttttggacgcgtacaactcaa

SEQ ID NO: 51 - DNA, 6495 bp, Artificial Sequence
  Synthetic Polynucleotide
cactcggtcgctacgctccgggcgtgagactgcggcgggcgctgcggacacatacaaagttacccacagattccgtggataagcaggggactaacatgtgaggcaaaacagcagggccgcgccggtggcgtttttccataggctccgccctcctgccagagttcacataaacagacgcttttccggtgcatctgtgggagccgtgaggctcaaccatgaatctgacagtacgggcgaaacccgacaggacttaaagatccccaccgtttccggcgggtcgctccctcttgcgctctcctgttccgaccctgccgtttaccggatacctgttccgcctttctcccttacgggaagtgtggcgctttctcatagctcacacactggtatctcggctcggtgtaggtcgttcgctccaagctgggctgtaagcaagaactccccgttcagcccgactgctgcgccttatccggtaactgttcacttgagtccaacccggaaaagcacggtaaaacgccactggcagcagccattggtaactgggagttcgcagaggatttgtttagctaaacacgcggttgctcttgaagtgtgcgccaaagtccggctacactggaaggacagatttggttgctgtgctctgcgaaagccagttaccacggttaagcagttccccaactgacttaaccttcgatcaaaccacctccccaggtggttttttcgtttacagggcaaaagattacgcgcagaaaaaaaggatctcaagaagatcctttgatcttttctactgaaccgctctagatttcagtgcaatttatctcttcaaatgtagcacctgaagtcagcccaggaggaagaggacatccggtcaaataaaacgaaaggctcagtcgaaagactgggcctttcgttttagacttagggaccctttatgacaacttgacggctacatcattcactttttcttcacaaccggcacggaactcgctcgggctggccccggtgcattttttaaatacccgcgagaaatagagttgatcgtcaaaaccaacattgcgaccgacggtggcgataggcatccgggtggtgctcaaaagcagcttcgcctggctgatacgttggtcctcgcgccagcttaagacgctaatccctaactgctggcggaaaagatgtgacagacgcgacggcgacaagcaaacatgctgtgcgacgctggcgatatcaaaattgctgtctgccaggtgatcgctgatgtactgacaagcctcgcgtacccgattatccatcggtggatggagcgactcgttaatcgcttccatgcgccgcagtaacaattgctcaagcagatttatcgccagcagctccgaatagcgcccttccccttgcccggcgttaatgatttgcccaaacaggtcgctgaaatgcggctggtgcgcttcatccgggcgaaagaaccccgtattggcaaatattgacggccagttaagccattcatgccagtaggcgcgcggacgaaagtaaacccactggtgataccattcgcgagcctccggatgacgaccgtagtgatgaatctctcctggcgggaacagcaaaatatcacccggtcggcaaacaaattctcgtccctgatttttcaccaccccctgaccgcgaatggtgagattgagaatataacctttcattcccagcggtcggtcgataaaaaaatcgagataaccgttggcctcaatcggcgttaaacccgccaccagatgggcattaaacgagtatcccggcagcaggggatcattttgcgcttcagccatacttttcatactcccaccattcagagaagaaaccaattgtccatattgcatcagacattgccgtcactgcgtcttttactggctcttctcgctaacccaaccggtaaccccgcttattaaaagcattctgtaacaaagcgggaccaaagccatgacaaaaacgcgtaacaaaagtgtctataatcacggcagaaaagtccacattgattatttgcacggcgtcacactttgctatgccatagcatttttatccataagattagcggatcctacctgacgctttttatcgcaactctctactgtttctccatacccgtttttttggacgcgtacaactcaagtctgacataaatgaccgctatgtctgaaccacgtttcgtacacctgcgggtgcacagcgactactcgatgatcgatggcctggccaaaaccgcaccgttggtaaaaaaggcggcggcgttgggtatgccagcactggcgatcaccgatttcaccaacctttgtggtctggtgaagttctacggagcgggacatggcgcagggattaagcctatcgtcggggcagattttaacgtccagtgcgacctgctgggtgatgagttaacccacctgacggtactggcggcgaacaataccggctatcagaatctgacgttgctgatctcaaaagcgtatcagcgcgggtacggtgccgccgggccgatcatcgatcgcgactggcttatcgaattaaacgaagggttgatccttctttccggcggacgcatgggcgacgtcggacgcagtcttttgcgtggtaacagcgcgctggtagatgagtgtgtcgcgttttatgaagaacacttcccggatcgctattttctcgagctgatccgcaccggcaggccggatgaagaaagctatctgcacgcggcggtggaactggcggaagcgcgcggtttgcccgtcgtggcgaccaacgacgtgcgctttatcgacagcagcgactttgacgcacacgaaatccgcgtcgcgatccacgacggctttaccctcgacgatcctaaacgcccgcgtaactattcgccgcagcaatatatgcgtagcgaagaggagatgtgtgagctgtttgccgacatccccgaagcccttgccaacaccgttgagatcgccaaacgctgtaacgtaaccgtgcgtcttggtgaatacttcctgccgcagttcccgaccggggacatgagcaccgaagattatctggtcaagcgtgcaaaagagggcctggaagagcgtctggcctttttattccctgatgaggaagaacgtcttaagcgccgcccggaatatgacgaacgtctggagactgaacttcaggttatcaaccagatgggcttcccgggctacttcctcatcgttatggaatttatccagtggtcgaaagataacggcgtaccggtagggccaggccgtggctccggtgcgggttcactggtggcctacgcgctgaaaatcaccgacctcgatccgctggaatttgacctgctgttcgaacgtttccttaacccggaacgtgtctccatgcctgacttcgacgttgacttctgtatggagaaacgcgatcaggttatcgagcacgtagcggacatgtacggtcgtgatgcggtatcgcagatcatcaccttcggtacaatggcggcgaaagcggtgatccgcgacgtaggccgcgtgctggggcatccgtacggctttgtcgatcgtatctcgaaactgatcccgcccgatccggggatgacgctggcgaaagcgtttgaagccgagccgcagctgccggaaatctacgaagcggatgaagaagttaaggcgctgatcgacatggcgcgcaaactggaaggggtcacccgtaacgccggtaagcacgccggtggggtggttatcgcgccgaccaaaattaccgattttgcgccgctttactgcgatgaagagggcaaacatccggtcacccagtttgataaaagcgacgttgaatacgccggactggtgaagttcgacttccttggtttgcgtacgctcaccatcatcaactgggcgctggagatgatcaacaagcggcgggcgaagaatggcgagccgccgctggatatcgctgcgatcccgctggatgataagaaaagcttcgacatgctgcaacgctcggaaaccacggcggtattccagcttgaatcgcgcggcatgaaggacctgatcaagcgtctacaacctgactgcttcgaagatatgatcgccctagtggcactgttccgccccggtccgttgcaatcagggatggtggataactttatcgaccgtaaacatggtcgtgaagagatctcctatccggacgtacagtggcagcatgaaagcctgaaaccggtactggagccaacctacggcattatcctgtatcaggaacaggtcatgcagattgcgcaggtgctttctggttataccctcggtggcgcggatatgctgcgtcgtgcgatgggtaagaaaaagccggaagagatggctaagcaacgttctgtatttgctgaaggtgcagaaaagaacggaatcaacgctgaactggcgatgaaaatcttcgacctggtggagaaattcgctggttacggatttaacaaatcgcactctgcggcctatgctttggtgtcatatcaaacgttatggctgaaagcgcactatcctgcggagtttatggcggcggtaatgaccgccgatatggacaacaccgagaaggtggtgggtctggtggatgagtgctggcggatggggctgaaaatcctgccaccagatataaactccggtctttaccatttctatgtcaacgacgacggcgaaatcgtgtatggtattggcgcgatcaaaggggtcggtgaaggtccgattgaggccatcatcgaagcccgtaataaaggcggctacttccgcgaactgtttgatctctgcgcccgtaccgacaccaaaaagttgaaccgtcgcgtgctggaaaaactgatcatgtccggggcgtttgaccgtcttgggccacattgcgcagcgctgatgaactcgctgggcgatgcgttaaaagcggcagatcaacacgcgaaagcggaagctatcggtcaggccgatatgttcggcgtgctggccgaagagccggaacaaattgaacaatcctacgccagctgccaaccgtggccggagcaggtggtattagatggggaacgtgaaacgttaggcctgtacctgaccggacaccctatcaaccagtatttaaaagagattgagcgttatgtcggaggcgtaaggctgaaagacatgcacccgacagaacgtggtaaagtcatcacggctgcggggctcgttgttgccgcgcgggttatggtcaccaagcgcggcaatcgtatcggtatctgcacgctggatgaccgttccgggcggctggaagtgatgttgtttactgacgccctggataaataccagcaattgctggaaaaagaccgcatacttatcgtcagcggacaggtcagctttgatgacttcagcggtgggcttaaaatgaccgctcgcgaagtgatggatattgacgaagcccgggaaaaatatgctcgcgggcttgctatctcgctgacggacaggcaaattgatgaccagcttttaaaccgactccgtcagtctctggaaccccaccgctctgggacaattccagtacatctctactatcagagggcggatgcacgcgcgcggttgcgttttggcgcgacgtggcgtgtctctccgagcgatcgtttattaaacgatctccgtggcctcattggttcggagcaggtggaactggagtttgactaaacttaattaacggcactcctcagccaagtcaaaagcctccgaccggaggcttttgactacatgcccatggcgtttacgccccgccctgccactcatcgcagtactgttgtaattcattaagcattctgccgacatggaagccatcacaaacggcatgatgaacctgaatcgccagcggcatcagcaccttgtcgccttgcgtataatatttgcccatagtgaaaacgggggcgaagaagttgtccatattggccacgtttaaatcaaaactggtgaaactcacccagggattggctgagacgaaaaacatattctcaataaaccctttagggaaataggccaggttttcaccgtaacacgccacatcttgcgaatatatgtgtagaaactgccggaaatcgtcgtggtattcactccagagcgatgaaaacgtttcagtttgctcatggaaaacggtgtaacaagggtgaacactatcccatatcaccagctcaccgtctttcattgccatacggaactccggatgagcattcatcaggcgggcaagaatgtgaataaaggccggataaaacttgtgcttatttttctttacggtctttaaaaaggccgtaatatccagctgaacggtctggttataggtacattgagcaactgactgaaatgcctcaaaatgttctttacgatgccattgggatatatcaacggtggtatatccagtgatttttttctccattttagcttccttagctcctgaaaatctcgataactcaaaaaatacgcccggtagtgatcttatttcattatggtgaaagttggaacctcttacgtgccaagccaaataggccgt

SEQ ID NO: 52 - DNA, 4944 bp, Artificial Sequence
  Synthetic Polynucleotide
cactcggtcgctacgctccgggcgtgagactgcggcgggcgctgcggacacatacaaagttacccacagattccgtggataagcaggggactaacatgtgaggcaaaacagcagggccgcgccggtggcgtttttccataggctccgccctcctgccagagttcacataaacagacgcttttccggtgcatctgtgggagccgtgaggctcaaccatgaatctgacagtacgggcgaaacccgacaggacttaaagatccccaccgtttccggcgggtcgctccctcttgcgctctcctgttccgaccctgccgtttaccggatacctgttccgcctttctcccttacgggaagtgtggcgctttctcatagctcacacactggtatctcggctcggtgtaggtcgttcgctccaagctgggctgtaagcaagaactccccgttcagcccgactgctgcgccttatccggtaactgttcacttgagtccaacccggaaaagcacggtaaaacgccactggcagcagccattggtaactgggagttcgcagaggatttgtttagctaaacacgcggttgctcttgaagtgtgcgccaaagtccggctacactggaaggacagatttggttgctgtgctctgcgaaagccagttaccacggttaagcagttccccaactgacttaaccttcgatcaaaccacctccccaggtggttttttcgtttacagggcaaaagattacgcgcagaaaaaaaggatctcaagaagatcctttgatcttttctactgaaccgctctagatttcagtgcaatttatctcttcaaatgtagcacctgaagtcagcccaggaggaagaggacatccggtcaaataaaacgaaaggctcagtcgaaagactgggcctttcgttttagacttagggaccctttatgacaacttgacggctacatcattcactttttcttcacaaccggcacggaactcgctcgggctggccccggtgcattttttaaatacccgcgagaaatagagttgatcgtcaaaaccaacattgcgaccgacggtggcgataggcatccgggtggtgctcaaaagcagcttcgcctggctgatacgttggtcctcgcgccagcttaagacgctaatccctaactgctggcggaaaagatgtgacagacgcgacggcgacaagcaaacatgctgtgcgacgctggcgatatcaaaattgctgtctgccaggtgatcgctgatgtactgacaagcctcgcgtacccgattatccatcggtggatggagcgactcgttaatcgcttccatgcgccgcagtaacaattgctcaagcagatttatcgccagcagctccgaatagcgcccttccccttgcccggcgttaatgatttgcccaaacaggtcgctgaaatgcggctggtgcgcttcatccgggcgaaagaaccccgtattggcaaatattgacggccagttaagccattcatgccagtaggcgcgcggacgaaagtaaacccactggtgataccattcgcgagcctccggatgacgaccgtagtgatgaatctctcctggcgggaacagcaaaatatcacccggtcggcaaacaaattctcgtccctgatttttcaccaccccctgaccgcgaatggtgagattgagaatataacctttcattcccagcggtcggtcgataaaaaaatcgagataaccgttggcctcaatcggcgttaaacccgccaccagatgggcattaaacgagtatcccggcagcaggggatcattttgcgcttcagccatacttttcatactcccaccattcagagaagaaaccaattgtccatattgcatcagacattgccgtcactgcgtcttttactggctcttctcgctaacccaaccggtaaccccgcttattaaaagcattctgtaacaaagcgggaccaaagccatgacaaaaacgcgtaacaaaagtgtctataatcacggcagaaaagtccacattgattatttgcacggcgtcacactttgctatgccatagcatttttatccataagattagcggatcctacctgacgctttttatcgcaactctctactgtttctccatacccgtttttttggacgcgtacaactcaagtctgacataaatgaccgctatgagttatcaggtcttagcccgaaaatggcgcccacaaacctttgctgacgtcgtcggccaggaacatgtgctgaccgcactggcgaacggcttgtcgttagggcgtattcatcatgcttatcttttttccggcacccgtggcgtcggaaaaacctctatcgcccgactgctggcgaaggggctaaactgcgaaaccggcattaccgcgacgccgtgcggcgtgtgcgataactgtcgtgaaatcgagcaggggcgctttgtcgatctgattgaaatcgacgccgcctcgcgcaccaaagttgaagatacccgcgacctgctggataacgtccagtacgctccggcgcgtggtcgtttcaaagtttatctgatcgacgaagtgcatatgctgtcgcgccacagctttaacgcactgttaaaaacccttgaagagccgccggagcacgttaagtttctgctggcgacgaccgatccacagaaattgccggtgacgattttgtcacgctgtctgcaatttcatctcaaggcgctggatgtcgagcaaattcgccatcagcttgagcacatcctcaacgaagaacatatcgctcacgagccgcgggcgctgcaattgctggcacgcgccgctgaaggcagcctgcgagatgccttaagtctgaccgaccaggcgattgccagcggtgacggccaggtttcaacccaggcggtcagtgcgatgctgggtacgcttgacgacgatcaggcgctgtcgctggttgaagcgatggtcgaggccaacggcgagcgcgtaatggcgctgattaatgaagccgctgcccgtggtatcgagtgggaagcgttgctggtggaaatgctcggcctgttgcatcgtattgcgatggtacaactttcgcctgctgcacttggcaacgacatggccgccatcgagctgcggatgcgtgaactggcgcgcaccataccgccgacggatattcagctttactatcagacgctgttgattggtcgcaaagaattaccgtatgcgccggaccgtcgcatgggcgttgagatgacgctgctgcgcgcgctggcattccatccgcgtatgccgctgcctgagccagaagtgccacgacagtcctttgcacccgtcgcgccaacggcagtaatgacgccaacccaggtgccgccgcaaccgcaatcagcgccgcagcaggcaccgactgtaccgctcccggaaaccaccagccaggtgctggcggcgcgccagcagttgcagcgcgtgcagggagcaaccaaagcaaaaaagagtgaaccggcagccgctacccgcgcgcggccggtgaataacgctgcgctggaaagactggcttcggtcaccgatcgcgttcaggcgcgtccggtgccatcggcgctggaaaaagcgccagccaaaaaagaagcgtatcgctggaaggcgaccactccggtgatgcagcaaaaagaagtggtcgccacgccgaaggcgctgaaaaaagcgctggaacatgaaaaaacgccggaactggcggcgaagctagcggcagaagccattgagcgcgacccgtgggcggcacaggtgagccaactttcgctaccaaaactggtcgaacaggtggcgttaaatgcctggaaagaggagagcgacaacgcagtatgtctgcatttgcgctcctctcagcggcatttgaacaaccgcggtgcacagcaaaaactggctgaagcgttgagcatgttaaaaggttcaacggttgaactgactatcgttgaagatgataatcccgcggtgcgtacgccgctgaaatggcgtcaggcgatatacgaagaaaaacttgcgcaggcgcgcgagtccattattgcggataataatattcagaccctgcgtcggttcttcgatgcggagctggatgaagaaagtatccgccccatttaaacttaattaacggcactcctcagccaagtcaaaagcctccgaccggaggcttttgactacatgcccatggcgtttacgccccgccctgccactcatcgcagtactgttgtaattcattaagcattctgccgacatggaagccatcacaaacggcatgatgaacctgaatcgccagcggcatcagcaccttgtcgccttgcgtataatatttgcccatagtgaaaacgggggcgaagaagttgtccatattggccacgtttaaatcaaaactggtgaaactcacccagggattggctgagacgaaaaacatattctcaataaaccctttagggaaataggccaggttttcaccgtaacacgccacatcttgcgaatatatgtgtagaaactgccggaaatcgtcgtggtattcactccagagcgatgaaaacgtttcagtttgctcatggaaaacggtgtaacaagggtgaacactatcccatatcaccagctcaccgtctttcattgccatacggaactccggatgagcattcatcaggcgggcaagaatgtgaataaaggccggataaaacttgtgcttatttttctttacggtctttaaaaaggccgtaatatccagctgaacggtctggttataggtacattgagcaactgactgaaatgcctcaaaatgttctttacgatgccattgggatatatcaacggtggtatatccagtgatttttttctccattttagcttccttagctcctgaaaatctcgataactcaaaaaatacgcccggtagtgatcttatttcattatggtgaaagttggaacctcttacgtgccaagccaaataggccgt

SEQ ID NO: 53 - DNA, 4944 bp, Artificial Sequence
  Synthetic Polynucleotide
cactcggtcgctacgctccgggcgtgagactgcggcgggcgctgcggacacatacaaagttacccacagattccgtggataagcaggggactaacatgtgaggcaaaacagcagggccgcgccggtggcgtttttccataggctccgccctcctgccagagttcacataaacagacgcttttccggtgcatctgtgggagccgtgaggctcaaccatgaatctgacagtacgggcgaaacccgacaggacttaaagatccccaccgtttccggcgggtcgctccctcttgcgctctcctgttccgaccctgccgtttaccggatacctgttccgcctttctcccttacgggaagtgtggcgctttctcatagctcacacactggtatctcggctcggtgtaggtcgttcgctccaagctgggctgtaagcaagaactccccgttcagcccgactgctgcgccttatccggtaactgttcacttgagtccaacccggaaaagcacggtaaaacgccactggcagcagccattggtaactgggagttcgcagaggatttgtttagctaaacacgcggttgctcttgaagtgtgcgccaaagtccggctacactggaaggacagatttggttgctgtgctctgcgaaagccagttaccacggttaagcagttccccaactgacttaaccttcgatcaaaccacctccccaggtggttttttcgtttacagggcaaaagattacgcgcagaaaaaaaggatctcaagaagatcctttgatcttttctactgaaccgctctagatttcagtgcaatttatctcttcaaatgtagcacctgaagtcagcccaggaggaagaggacatccggtcaaataaaacgaaaggctcagtcgaaagactgggcctttcgttttagacttagggaccctttatgacaacttgacggctacatcattcactttttcttcacaaccggcacggaactcgctcgggctggccccggtgcattttttaaatacccgcgagaaatagagttgatcgtcaaaaccaacattgcgaccgacggtggcgataggcatccgggtggtgctcaaaagcagcttcgcctggctgatacgttggtcctcgcgccagcttaagacgctaatccctaactgctggcggaaaagatgtgacagacgcgacggcgacaagcaaacatgctgtgcgacgctggcgatatcaaaattgctgtctgccaggtgatcgctgatgtactgacaagcctcgcgtacccgattatccatcggtggatggagcgactcgttaatcgcttccatgcgccgcagtaacaattgctcaagcagatttatcgccagcagctccgaatagcgcccttccccttgcccggcgttaatgatttgcccaaacaggtcgctgaaatgcggctggtgcgcttcatccgggcgaaagaaccccgtattggcaaatattgacggccagttaagccattcatgccagtaggcgcgcggacgaaagtaaacccactggtgataccattcgcgagcctccggatgacgaccgtagtgatgaatctctcctggcgggaacagcaaaatatcacccggtcggcaaacaaattctcgtccctgatttttcaccaccccctgaccgcgaatggtgagattgagaatataacctttcattcccagcggtcggtcgataaaaaaatcgagataaccgttggcctcaatcggcgttaaacccgccaccagatgggcattaaacgagtatcccggcagcaggggatcattttgcgcttcagccatacttttcatactcccaccattcagagaagaaaccaattgtccatattgcatcagacattgccgtcactgcgtcttttactggctcttctcgctaacccaaccggtaaccccgcttattaaaagcattctgtaacaaagcgggaccaaagccatgacaaaaacgcgtaacaaaagtgtctataatcacggcagaaaagtccacattgattatttgcacggcgtcacactttgctatgccatagcatttttatccataagattagcggatcctacctgacgctttttatcgcaactctctactgtttctccatacccgtttttttggacgcgtacaactcaagtctgacataaatgaccgctatgagttatcaggtcttagcccgaaaatggcgcccacaaacctttgctgacgtcgtcggccaggaacatgtgctgaccgcactggcgaacggcttgtcgttagggcgtattcatcatgcttatcttttttccggcacccgtggcgtcggaaaaacctctatcgcccgactgctggcgaaggggctaaactgcgaaaccggcattaccgcgacgccgtgcggcgtgtgcgataactgtcgtgaaatcgagcaggggcgctttgtcgatctgattgaaatcgacgccgcctcgcgcaccaaagttgaagatacccgcgacctgctggataacgtccagtacgctccggcgcgtgatcgtttcaaagtttatctgatcgacgaagtgcatatgctgtcgcgccacagctttaacgcactgttaaaaacccttgaagagccgccggagcacgttaagtttctgctggcgacgaccgatccacagaaattgccggtgacgattttgtcacgctgtctgcaatttcatctcaaggcgctggatgtcgagcaaattcgccatcagcttgagcacatcctcaacgaagaacatatcgctcacgagccgcgggcgctgcaattgctggcacgcgccgctgaaggcagcctgcgagatgccttaagtctgaccgaccaggcgattgccagcggtgacggccaggtttcaacccaggcggtcagtgcgatgctgggtacgcttgacgacgatcaggcgctgtcgctggttgaagcgatggtcgaggccaacggcgagcgcgtaatggcgctgattaatgaagccgctgcccgtggtatcgagtgggaagcgttgctggtggaaatgctcggcctgttgcatcgtattgcgatggtacaactttcgcctgctgcacttggcaacgacatggccgccatcgagctgcggatgcgtgaactggcgcgcaccataccgccgacggatattcagctttactatcagacgctgttgattggtcgcaaagaattaccgtatgcgccggaccgtcgcatgggcgttgagatgacgctgctgcgcgcgctggcattccatccgcgtatgccgctgcctgagccagaagtgccacgacagtcctttgcacccgtcgcgccaacggcagtaatgacgccaacccaggtgccgccgcaaccgcaatcagcgccgcagcaggcaccgactgtaccgctcccggaaaccaccagccaggtgctggcggcgcgccagcagttgcagcgcgtgcagggagcaaccaaagcaaaaaagagtgaaccggcagccgctacccgcgcgcggccggtgaataacgctgcgctggaaagactggcttcggtcaccgatcgcgttcaggcgcgtccggtgccatcggcgctggaaaaagcgccagccaaaaaagaagcgtatcgctggaaggcgaccactccggtgatgcagcaaaaagaagtggtcgccacgccgaaggcgctgaaaaaagcgctggaacatgaaaaaacgccggaactggcggcgaagctagcggcagaagccattgagcgcgacccgtgggcggcacaggtgagccaactttcgctaccaaaactggtcgaacaggtggcgttaaatgcctggaaagaggagagcgacaacgcagtatgtctgcatttgcgctcctctcagcggcatttgaacaaccgcggtgcacagcaaaaactggctgaagcgttgagcatgttaaaaggttcaacggttgaactgactatcgttgaagatgataatcccgcggtgcgtacgccgctggagtggcgtcaggcgatatacgaagaaaaacttgcgcaggcgcgcgagtccattattgcggataataatattcagaccctgcgtcggttcttcgatgcggagctggatgaagaaagtatccgccccatttaaacttaattaacggcactcctcagccaagtcaaaagcctccgaccggaggcttttgactacatgcccatggcgtttacgccccgccctgccactcatcgcagtactgttgtaattcattaagcattctgccgacatggaagccatcacaaacggcatgatgaacctgaatcgccagcggcatcagcaccttgtcgccttgcgtataatatttgcccatagtgaaaacgggggcgaagaagttgtccatattggccacgtttaaatcaaaactggtgaaactcacccagggattggctgagacgaaaaacatattctcaataaaccctttagggaaataggccaggttttcaccgtaacacgccacatcttgcgaatatatgtgtagaaactgccggaaatcgtcgtggtattcactccagagcgatgaaaacgtttcagtttgctcatggaaaacggtgtaacaagggtgaacactatcccatatcaccagctcaccgtctttcattgccatacggaactccggatgagcattcatcaggcgggcaagaatgtgaataaaggccggataaaacttgtgcttatttttctttacggtctttaaaaaggccgtaatatccagctgaacggtctggttataggtacattgagcaactgactgaaatgcctcaaaatgttctttacgatgccattgggatatatcaacggtggtatatccagtgatttttttctccattttagcttccttagctcctgaaaatctcgataactcaaaaaatacgcccggtagtgatcttatttcattatggtgaaagttggaacctcttacgtgccaagccaaataggccgt

SEQ ID NO: 54 - DNA, 7256 bp, Artificial Sequence
  Synthetic Polynucleotide
cactcggtcgctacgctccgggcgtgagactgcggcgggcgctgcggacacatacaaagttacccacagattccgtggataagcaggggactaacatgtgaggcaaaacagcagggccgcgccggtggcgtttttccataggctccgccctcctgccagagttcacataaacagacgcttttccggtgcatctgtgggagccgtgaggctcaaccatgaatctgacagtacgggcgaaacccgacaggacttaaagatccccaccgtttccggcgggtcgctccctcttgcgctctcctgttccgaccctgccgtttaccggatacctgttccgcctttctcccttacgggaagtgtggcgctttctcatagctcacacactggtatctcggctcggtgtaggtcgttcgctccaagctgggctgtaagcaagaactccccgttcagcccgactgctgcgccttatccggtaactgttcacttgagtccaacccggaaaagcacggtaaaacgccactggcagcagccattggtaactgggagttcgcagaggatttgtttagctaaacacgcggttgctcttgaagtgtgcgccaaagtccggctacactggaaggacagatttggttgctgtgctctgcgaaagccagttaccacggttaagcagttccccaactgacttaaccttcgatcaaaccacctccccaggtggttttttcgtttacagggcaaaagattacgcgcagaaaaaaaggatctcaagaagatcctttgatcttttctactgaaccgctctagatttcagtgcaatttatctcttcaaatgtagcacctgaagtcagcccaggaggaagaggacatccggtcaaataaaacgaaaggctcagtcgaaagactgggcctttcgttttagacttagggaccctttatgacaacttgacggctacatcattcactttttcttcacaaccggcacggaactcgctcgggctggccccggtgcattttttaaatacccgcgagaaatagagttgatcgtcaaaaccaacattgcgaccgacggtggcgataggcatccgggtggtgctcaaaagcagcttcgcctggctgatacgttggtcctcgcgccagcttaagacgctaatccctaactgctggcggaaaagatgtgacagacgcgacggcgacaagcaaacatgctgtgcgacgctggcgatatcaaaattgctgtctgccaggtgatcgctgatgtactgacaagcctcgcgtacccgattatccatcggtggatggagcgactcgttaatcgcttccatgcgccgcagtaacaattgctcaagcagatttatcgccagcagctccgaatagcgcccttccccttgcccggcgttaatgatttgcccaaacaggtcgctgaaatgcggctggtgcgcttcatccgggcgaaagaaccccgtattggcaaatattgacggccagttaagccattcatgccagtaggcgcgcggacgaaagtaaacccactggtgataccattcgcgagcctccggatgacgaccgtagtgatgaatctctcctggcgggaacagcaaaatatcacccggtcggcaaacaaattctcgtccctgatttttcaccaccccctgaccgcgaatggtgagattgagaatataacctttcattcccagcggtcggtcgataaaaaaatcgagataaccgttggcctcaatcggcgttaaacccgccaccagatgggcattaaacgagtatcccggcagcaggggatcattttgcgcttcagccatacttttcatactcccaccattcagagaagaaaccaattgtccatattgcatcagacattgccgtcactgcgtcttttactggctcttctcgctaacccaaccggtaaccccgcttattaaaagcattctgtaacaaagcgggaccaaagccatgacaaaaacgcgtaacaaaagtgtctataatcacggcagaaaagtccacattgattatttgcacggcgtcacactttgctatgccatagcatttttatccataagattagcggatcctacctgacgctttttatcgcaactctctactgtttctccatacccgtttttttggacgcgtacaactcaagtctgacataaatgaccgctatgagcactgcaattacacgccagatcgttctcgctaccgcaaccaccggtatgaaccagattggtgcgcactatgaaggccacaagatcattgagattggtgccgttgaagtggtgaaccgtcgcctgacgggcaataacttccatgtttatctcaaacccgatcggctggtggatccggaagcctttggcgtacatggtattgccgatgaatttttgctcgataagcccacgtttgccgaagtagccgatgagttcatggactatattcgcggcgcggagttggtgatccataacgcagcgttcgatatcggctttatggactacgagttttcgttgcttaagcgcgatattccgaagaccaatactttctgtaaggtcaccgatagccttgcggtggcgaggaaaatgtttcccggtaagcgcaacagcctcgatgcgttatgtgctcgctacgaaatagataacagtaaacgaacgctgcacggggcattactcgatgcccagatccttgcggaagtttatctggcgatgaccggtggtcaaacgtcgatggcttttgcgatggaaggagagacacaacagcaacaaggtgaagcaacaattcagcgcattgtacgtcaggcaagtaagttacgcgttgtttttgcgacagatgaagagattgcagctcatgaagcccgtctcgatctggtgcagaagaaaggcggaagttgcctctggcgagcataagtcgagattaagtaaaccggaatctgaagatgtctgaaccacgtttcgtacacctgcgggtgcacagcgactactcgatgatcgatggcctggccaaaaccgcaccgttggtaaaaaaggcggcggcgttgggtatgccagcactggcgatcaccgatttcaccaacctttgtggtctggtgaagttctacggagcgggacatggcgcagggattaagcctatcgtcggggcagattttaacgtccagtgcgacctgctgggtgatgagttaacccacctgacggtactggcggcgaacaataccggctatcagaatctgacgttgctgatctcaaaagcgtatcagcgcgggtacggtgccgccgggccgatcatcgatcgcgactggcttatcgaattaaacgaagggttgatccttctttccggcggacgcatgggcgacgtcggacgcagtcttttgcgtggtaacagcgcgctggtagatgagtgtgtcgcgttttatgaagaacacttcccggatcgctattttctcgagctgatccgcaccggcaggccggatgaagaaagctatctgcacgcggcggtggaactggcggaagcgcgcggtttgcccgtcgtggcgaccaacgacgtgcgctttatcgacagcagcgactttgacgcacacgaaatccgcgtcgcgatccacgacggctttaccctcgacgatcctaaacgcccgcgtaactattcgccgcagcaatatatgcgtagcgaagaggagatgtgtgagctgtttgccgacatccccgaagcccttgccaacaccgttgagatcgccaaacgctgtaacgtaaccgtgcgtcttggtgaatacttcctgccgcagttcccgaccggggacatgagcaccgaagattatctggtcaagcgtgcaaaagagggcctggaagagcgtctggcctttttattccctgatgaggaagaacgtcttaagcgccgcccggaatatgacgaacgtctggagactgaacttcaggttatcaaccagatgggcttcccgggctacttcctcatcgttatggaatttatccagtggtcgaaagataacggcgtaccggtagggccaggccgtggctccggtgcgggttcactggtggcctacgcgctgaaaatcaccgacctcgatccgctggaatttgacctgctgttcgaacgtttccttaacccggaacgtgtctccatgcctgacttcgacgttgacttctgtatggagaaacgcgatcaggttatcgagcacgtagcggacatgtacggtcgtgatgcggtatcgcagatcatcaccttcggtacaatggcggcgaaagcggtgatccgcgacgtaggccgcgtgctggggcatccgtacggctttgtcgatcgtatctcgaaactgatcccgcccgatccggggatgacgctggcgaaagcgtttgaagccgagccgcagctgccggaaatctacgaagcggatgaagaagttaaggcgctgatcgacatggcgcgcaaactggaaggggtcacccgtaacgccggtaagcacgccggtggggtggttatcgcgccgaccaaaattaccgattttgcgccgctttactgcgatgaagagggcaaacatccggtcacccagtttgataaaagcgacgttgaatacgccggactggtgaagttcgacttccttggtttgcgtacgctcaccatcatcaactgggcgctggagatgatcaacaagcggcgggcgaagaatggcgagccgccgctggatatcgctgcgatcccgctggatgataagaaaagcttcgacatgctgcaacgctcggaaaccacggcggtattccagcttgaatcgcgcggcatgaaggacctgatcaagcgtctacaacctgactgcttcgaagatatgatcgccctagtggcactgttccgccccggtccgttgcaatcagggatggtggataactttatcgaccgtaaacatggtcgtgaagagatctcctatccggacgtacagtggcagcatgaaagcctgaaaccggtactggagccaacctacggcattatcctgtatcaggaacaggtcatgcagattgcgcaggtgctttctggttataccctcggtggcgcggatatgctgcgtcgtgcgatgggtaagaaaaagccggaagagatggctaagcaacgttctgtatttgctgaaggtgcagaaaagaacggaatcaacgctgaactggcgatgaaaatcttcgacctggtggagaaattcgctggttacggatttaacaaatcgcactctgcggcctatgctttggtgtcatatcaaacgttatggctgaaagcgcactatcctgcggagtttatggcggcggtaatgaccgccgatatggacaacaccgagaaggtggtgggtctggtggatgagtgctggcggatggggctgaaaatcctgccaccagatataaactccggtctttaccatttccacgtcaacgacgacggcgaaatcgtgtatggtattggcgcgatcaaaggggtcggtgaaggtccgattgaggccatcatcgaagcccgtaataaaggcggctacttccgcgaactgtttgatctctgcgcccgtaccgacaccaaaaagttgaaccgtcgcgtgctggaaaaactgatcatgccgggggcgtttgaccgtcttgggccacatcgcgcagcgctgatgaactcgctgggcgatgcgttaaaagcggcagatcaacacgcgaaagcggaagctatcggtcaggccgatatgttcggcgtgctggccgaagagccggaacaaattgaacaatcctacgccagctgccaaccgtggccggagcaggtggtattagatggggaacgtgaaacgttaggcctgtacctgaccggacaccctatcaaccagtatttaaaagagattgagcgttatgtcggaggcgtaaggctgaaagacatgcacccgacagaacgtggtaaagtcatcacggctgcggggctcgttgttgccgcgcgggttatggtcaccaagcgcggcaatcgtatcggtatctgcacgctggatgaccgttccgggcggctggaagtgatgttgtttactgacgccctggataaataccagcaattgctggaaaaagaccgcatacttatcgtcagcggacaggtcagctttgatgacttcagcggtgggcttaaaatgaccgctcgcgaagtgatggatattgacgaagcccgggaaaaatatgctcgcgggcttgctatctcgctgacggacaggcaaattgatgaccagcttttaaaccgactccgtcagtctctggaaccccaccgctctgggacaattccagtacatctctactatcagagggcggatgcacgcgcgcggttgcgttttggcgcgacgtggcgtgtctctccgagcgatcgtttattaaacgatctccgtggcctcattggttcggagcaggtggaactggagtttgactaaacttaattaacggcactcctcagccaagtcaaaagcctccgaccggaggcttttgactacatgcccatggcgtttacgccccgccctgccactcatcgcagtactgttgtaattcattaagcattctgccgacatggaagccatcacaaacggcatgatgaacctgaatcgccagcggcatcagcaccttgtcgccttgcgtataatatttgcccatagtgaaaacgggggcgaagaagttgtccatattggccacgtttaaatcaaaactggtgaaactcacccagggattggctgagacgaaaaacatattctcaataaaccctttagggaaataggccaggttttcaccgtaacacgccacatcttgcgaatatatgtgtagaaactgccggaaatcgtcgtggtattcactccagagcgatgaaaacgtttcagtttgctcatggaaaacggtgtaacaagggtgaacactatcccatatcaccagctcaccgtctttcattgccatacggaactccggatgagcattcatcaggcgggcaagaatgtgaataaaggccggataaaacttgtgcttatttttctttacggtctttaaaaaggccgtaatatccagctgaacggtctggttataggtacattgagcaactgactgaaatgcctcaaaatgttctttacgatgccattgggatatatcaacggtggtatatccagtgatttttttctccattttagcttccttagctcctgaaaatctcgataactcaaaaaatacgcccggtagtgatcttatttcattatggtgaaagttggaacctcttacgtgccaagccaaataggccgt

SEQ ID NO: 55 - DNA, 7256 bp, Artificial Sequence
  Synthetic Polynucleotide
cactcggtcgctacgctccgggcgtgagactgcggcgggcgctgcggacacatacaaagttacccacagattccgtggataagcaggggactaacatgtgaggcaaaacagcagggccgcgccggtggcgtttttccataggctccgccctcctgccagagttcacataaacagacgcttttccggtgcatctgtgggagccgtgaggctcaaccatgaatctgacagtacgggcgaaacccgacaggacttaaagatccccaccgtttccggcgggtcgctccctcttgcgctctcctgttccgaccctgccgtttaccggatacctgttccgcctttctcccttacgggaagtgtggcgctttctcatagctcacacactggtatctcggctcggtgtaggtcgttcgctccaagctgggctgtaagcaagaactccccgttcagcccgactgctgcgccttatccggtaactgttcacttgagtccaacccggaaaagcacggtaaaacgccactggcagcagccattggtaactgggagttcgcagaggatttgtttagctaaacacgcggttgctcttgaagtgtgcgccaaagtccggctacactggaaggacagatttggttgctgtgctctgcgaaagccagttaccacggttaagcagttccccaactgacttaaccttcgatcaaaccacctccccaggtggttttttcgtttacagggcaaaagattacgcgcagaaaaaaaggatctcaagaagatcctttgatcttttctactgaaccgctctagatttcagtgcaatttatctcttcaaatgtagcacctgaagtcagcccaggaggaagaggacatccggtcaaataaaacgaaaggctcagtcgaaagactgggcctttcgttttagacttagggaccctttatgacaacttgacggctacatcattcactttttcttcacaaccggcacggaactcgctcgggctggccccggtgcattttttaaatacccgcgagaaatagagttgatcgtcaaaaccaacattgcgaccgacggtggcgataggcatccgggtggtgctcaaaagcagcttcgcctggctgatacgttggtcctcgcgccagcttaagacgctaatccctaactgctggcggaaaagatgtgacagacgcgacggcgacaagcaaacatgctgtgcgacgctggcgatatcaaaattgctgtctgccaggtgatcgctgatgtactgacaagcctcgcgtacccgattatccatcggtggatggagcgactcgttaatcgcttccatgcgccgcagtaacaattgctcaagcagatttatcgccagcagctccgaatagcgcccttccccttgcccggcgttaatgatttgcccaaacaggtcgctgaaatgcggctggtgcgcttcatccgggcgaaagaaccccgtattggcaaatattgacggccagttaagccattcatgccagtaggcgcgcggacgaaagtaaacccactggtgataccattcgcgagcctccggatgacgaccgtagtgatgaatctctcctggcgggaacagcaaaatatcacccggtcggcaaacaaattctcgtccctgatttttcaccaccccctgaccgcgaatggtgagattgagaatataacctttcattcccagcggtcggtcgataaaaaaatcgagataaccgttggcctcaatcggcgttaaacccgccaccagatgggcattaaacgagtatcccggcagcaggggatcattttgcgcttcagccatacttttcatactcccaccattcagagaagaaaccaattgtccatattgcatcagacattgccgtcactgcgtcttttactggctcttctcgctaacccaaccggtaaccccgcttattaaaagcattctgtaacaaagcgggaccaaagccatgacaaaaacgcgtaacaaaagtgtctataatcacggcagaaaagtccacattgattatttgcacggcgtcacactttgctatgccatagcatttttatccataagattagcggatcctacctgacgctttttatcgcaactctctactgtttctccatacccgtttttttggacgcgtacaactcaagtctgacataaatgaccgctatgagcactgcaattacacgccagatcgttctcgctaccgcaaccaccggtatgaaccagattggtgcgcactatgaaggccacaagatcattgagattggtgccgttgaagtggtgaaccgtcgcctgacgggcaataacttccatgtttatctcaaacccgatcggctggtggatccggaagcctttggcgtacatggtattgccgatgaatttttgctcgataagcccacgtttgccgaagtagccgatgagttcatggactatattcgcggcgcggagttggtgatccataacgcagcgttcgatatcggctttatggactacgagttttcgttgcttaagcgcgatattccgaagaccaatactttctgtaaggtcaccgatagccttgcggtggcgaggaaaatgtttcccggtaagcgcaacagcctcgatgcgttatgtgctcgctacgaaatagataacagtaaacgaacgctgcacggggcattactcgatgcccagatccttgcggaagtttatctggcgatgaccggtggtcaaacgtcgatggcttttgcgatggaaggagagacacaacagcaacaaggtgaagcaacaattcagcgcattgtacgtcaggcaagtaagttacgcgttgtttttgcgacagatgaagagattgcagctcatgaagcccgtctcgatctggtgcagaagaaaggcggaagttgcctctggcgagcataagtcgagattaagtaaaccggaatctgaagatgtctgaaccacgtttcgtacacctgcgggtgcacagcgactactcgatgatcgatggcctggccaaaaccgcaccgttggtaaaaaaggcggcggcgttgggtatgccagcactggcgatcaccgatttcaccaacctttgtggtctggtgaagttctacggagcgggacatggcgcagggattaagcctatcgtcggggcagattttaacgtccagtgcgacctgctgggtgatgagttaacccacctgacggtactggcggcgaacaataccggctatcagaatctgacgttgctgatctcaaaagcgtatcagcgcgggtacggtgccgccgggccgatcatcgatcgcgactggcttatcgaattaaacgaagggttgatccttctttccggcggacgcatgggcgacgtcggacgcagtcttttgcgtggtaacagcgcgctggtagatgagtgtgtcgcgttttatgaagaacacttcccggatcgctattttctcgagctgatccgcaccggcaggccggatgaagaaagctatctgcacgcggcggtggaactggcggaagcgcgcggtttgcccgtcgtggcgaccaacgacgtgcgctttatcgacagcagcgactttgacgcacacgaaatccgcgtcgcgatccacgacggctttaccctcgacgatcctaaacgcccgcgtaactattcgccgcagcaatatatgcgtagcgaagaggagatgtgtgagctgtttgccgacatccccgaagcccttgccaacaccgttgagatcgccaaacgctgtaacgtaaccgtgcgtcttggtgaatacttcctgccgcagttcccgaccggggacatgagcaccgaagattatctggtcaagcgtgcaaaagagggcctggaagagcgtctggcctttttattccctgatgaggaagaacgtcttaagcgccgcccggaatatgacgaacgtctggagactgaacttcaggttatcaaccagatgggcttcccgggctacttcctcatcgttatggaatttatccagtggtcgaaagataacggcgtaccggtagggccaggccgtggctccggtgcgggttcactggtggcctacgcgctgaaaatcaccgacctcgatccgctggaatttgacctgctgttcgaacgtttccttaacccggaacgtgtctccatgcctgacttcgacgttgacttctgtatggagaaacgcgatcaggttatcgagcacgtagcggacatgtacggtcgtgatgcggtatcgcagatcatcaccttcggtacaatggcggcgaaagcggtgatccgcgacgtaggccgcgtgctggggcatccgtacggctttgtcgatcgtatctcgaaactgatcccgcccgatccggggatgacgctggcgaaagcgtttgaagccgagccgcagctgccggaaatctacgaagcggatgaagaagttaaggcgctgatcgacatggcgcgcaaactggaaggggtcacccgtaacgccggtaagcacgccggtggggtggttatcgcgccgaccaaaattaccgattttgcgccgctttactgcgatgaagagggcaaacatccggtcacccagtttgataaaagcgacgttgaatacgccggactggtgaagttcgacttccttggtttgcgtacgctcaccatcatcaactgggcgctggagatgatcaacaagcggcgggcgaagaatggcgagccgccgctggatatcgctgcgatcccgctggatgataagaaaagcttcgacatgctgcaacgctcggaaaccacggcggtattccagcttgaatcgcgcggcatgaaggacctgatcaagcgtctacaacctgactgcttcgaagatatgatcgccctagtggcactgttccgccccggtccgttgcaatcagggatggtggataactttatcgaccgtaaacatggtcgtgaagagatctcctatccggacgtacagtggcagcatgaaagcctgaaaccggtactggagccaacctacggcattatcctgtatcaggaacaggtcatgcagattgcgcaggtgctttctggttataccctcggtggcgcggatatgctgcgtcgtgcgatgggtaagaaaaagccggaagagatggctaagcaacgttctgtatttgctgaaggtgcagaaaagaacggaatcaacgctgaactggcgatgaaaatcttcgacctggtggagaaattcgctggttacggatttaacaaatcgcactctgcggcctatgctttggtgtcatatcaaacgttatggctgaaagcgcactatcctgcggagtttatggcggcggtaatgaccgccgatatggacaacaccgagaaggtggtgggtctggtggatgagtgctggcggatggggctgaaaatcctgccaccagatataaactccggtctttaccatttctatgtcaacgacgacggcgaaatcgtgtatggtattggcgcgatcaaaggggtcggtgaaggtccgattgaggccatcatcgaagcccgtaataaaggcggctacttccgcgaactgtttgatctctgcgcccgtaccgacaccaaaaagttgaaccgtcgcgtgctggaaaaactgatcatgtccggggcgtttgaccgtcttgggccacattgcgcagcgctgatgaactcgctgggcgatgcgttaaaagcggcagatcaacacgcgaaagcggaagctatcggtcaggccgatatgttcggcgtgctggccgaagagccggaacaaattgaacaatcctacgccagctgccaaccgtggccggagcaggtggtattagatggggaacgtgaaacgttaggcctgtacctgaccggacaccctatcaaccagtatttaaaagagattgagcgttatgtcggaggcgtaaggctgaaagacatgcacccgacagaacgtggtaaagtcatcacggctgcggggctcgttgttgccgcgcgggttatggtcaccaagcgcggcaatcgtatcggtatctgcacgctggatgaccgttccgggcggctggaagtgatgttgtttactgacgccctggataaataccagcaattgctggaaaaagaccgcatacttatcgtcagcggacaggtcagctttgatgacttcagcggtgggcttaaaatgaccgctcgcgaagtgatggatattgacgaagcccgggaaaaatatgctcgcgggcttgctatctcgctgacggacaggcaaattgatgaccagcttttaaaccgactccgtcagtctctggaaccccaccgctctgggacaattccagtacatctctactatcagagggcggatgcacgcgcgcggttgcgttttggcgcgacgtggcgtgtctctccgagcgatcgtttattaaacgatctccgtggcctcattggttcggagcaggtggaactggagtttgactaaacttaattaacggcactcctcagccaagtcaaaagcctccgaccggaggcttttgactacatgcccatggcgtttacgccccgccctgccactcatcgcagtactgttgtaattcattaagcattctgccgacatggaagccatcacaaacggcatgatgaacctgaatcgccagcggcatcagcaccttgtcgccttgcgtataatatttgcccatagtgaaaacgggggcgaagaagttgtccatattggccacgtttaaatcaaaactggtgaaactcacccagggattggctgagacgaaaaacatattctcaataaaccctttagggaaataggccaggttttcaccgtaacacgccacatcttgcgaatatatgtgtagaaactgccggaaatcgtcgtggtattcactccagagcgatgaaaacgtttcagtttgctcatggaaaacggtgtaacaagggtgaacactatcccatatcaccagctcaccgtctttcattgccatacggaactccggatgagcattcatcaggcgggcaagaatgtgaataaaggccggataaaacttgtgcttatttttctttacggtctttaaaaaggccgtaatatccagctgaacggtctggttataggtacattgagcaactgactgaaatgcctcaaaatgttctttacgatgccattgggatatatcaacggtggtatatccagtgatttttttctccattttagcttccttagctcctgaaaatctcgataactcaaaaaatacgcccggtagtgatcttatttcattatggtgaaagttggaacctcttacgtgccaagccaaataggccgt

SEQ ID NO: 56 - DNA, 5705 bp, Artificial Sequence
  Synthetic Polynucleotide
cactcggtcgctacgctccgggcgtgagactgcggcgggcgctgcggacacatacaaagttacccacagattccgtggataagcaggggactaacatgtgaggcaaaacagcagggccgcgccggtggcgtttttccataggctccgccctcctgccagagttcacataaacagacgcttttccggtgcatctgtgggagccgtgaggctcaaccatgaatctgacagtacgggcgaaacccgacaggacttaaagatccccaccgtttccggcgggtcgctccctcttgcgctctcctgttccgaccctgccgtttaccggatacctgttccgcctttctcccttacgggaagtgtggcgctttctcatagctcacacactggtatctcggctcggtgtaggtcgttcgctccaagctgggctgtaagcaagaactccccgttcagcccgactgctgcgccttatccggtaactgttcacttgagtccaacccggaaaagcacggtaaaacgccactggcagcagccattggtaactgggagttcgcagaggatttgtttagctaaacacgcggttgctcttgaagtgtgcgccaaagtccggctacactggaaggacagatttggttgctgtgctctgcgaaagccagttaccacggttaagcagttccccaactgacttaaccttcgatcaaaccacctccccaggtggttttttcgtttacagggcaaaagattacgcgcagaaaaaaaggatctcaagaagatcctttgatcttttctactgaaccgctctagatttcagtgcaatttatctcttcaaatgtagcacctgaagtcagcccaggaggaagaggacatccggtcaaataaaacgaaaggctcagtcgaaagactgggcctttcgttttagacttagggaccctttatgacaacttgacggctacatcattcactttttcttcacaaccggcacggaactcgctcgggctggccccggtgcattttttaaatacccgcgagaaatagagttgatcgtcaaaaccaacattgcgaccgacggtggcgataggcatccgggtggtgctcaaaagcagcttcgcctggctgatacgttggtcctcgcgccagcttaagacgctaatccctaactgctggcggaaaagatgtgacagacgcgacggcgacaagcaaacatgctgtgcgacgctggcgatatcaaaattgctgtctgccaggtgatcgctgatgtactgacaagcctcgcgtacccgattatccatcggtggatggagcgactcgttaatcgcttccatgcgccgcagtaacaattgctcaagcagatttatcgccagcagctccgaatagcgcccttccccttgcccggcgttaatgatttgcccaaacaggtcgctgaaatgcggctggtgcgcttcatccgggcgaaagaaccccgtattggcaaatattgacggccagttaagccattcatgccagtaggcgcgcggacgaaagtaaacccactggtgataccattcgcgagcctccggatgacgaccgtagtgatgaatctctcctggcgggaacagcaaaatatcacccggtcggcaaacaaattctcgtccctgatttttcaccaccccctgaccgcgaatggtgagattgagaatataacctttcattcccagcggtcggtcgataaaaaaatcgagataaccgttggcctcaatcggcgttaaacccgccaccagatgggcattaaacgagtatcccggcagcaggggatcattttgcgcttcagccatacttttcatactcccaccattcagagaagaaaccaattgtccatattgcatcagacattgccgtcactgcgtcttttactggctcttctcgctaacccaaccggtaaccccgcttattaaaagcattctgtaacaaagcgggaccaaagccatgacaaaaacgcgtaacaaaagtgtctataatcacggcagaaaagtccacattgattatttgcacggcgtcacactttgctatgccatagcatttttatccataagattagcggatcctacctgacgctttttatcgcaactctctactgtttctccatacccgtttttttggacgcgtacaactcaagtctgacataaatgaccgctatgagcactgcaattacacgccagatcgttctcgctaccgcaaccaccggtatgaaccagattggtgcgcactatgaaggccacaagatcattgagattggtgccgttgaagtggtgaaccgtcgcctgacgggcaataacttccatgtttatctcaaacccgatcggctggtggatccggaagcctttggcgtacatggtattgccgatgaatttttgctcgataagcccacgtttgccgaagtagccgatgagttcatggactatattcgcggcgcggagttggtgatccataacgcagcgttcgatatcggctttatggactacgagttttcgttgcttaagcgcgatattccgaagaccaatactttctgtaaggtcaccgatagccttgcggtggcgaggaaaatgtttcccggtaagcgcaacagcctcgatgcgttatgtgctcgctacgaaatagataacagtaaacgaacgctgcacggggcattactcgatgcccagatccttgcggaagtttatctggcgatgaccggtggtcaaacgtcgatggcttttgcgatggaaggagagacacaacagcaacaaggtgaagcaacaattcagcgcattgtacgtcaggcaagtaagttacgcgttgtttttgcgacagatgaagagattgcagctcatgaagcccgtctcgatctggtgcagaagaaaggcggaagttgcctctggcgagcataatccaccttccagcgtttcagagcctgccaatgagttatcaggtcttagcccgaaaatggcgcccacaaacctttgctgacgtcgtcggccaggaacatgtgctgaccgcactggcgaacggcttgtcgttagggcgtattcatcatgcttatcttttttccggcacccgtggcgtcggaaaaacctctatcgcccgactgctggcgaaggggctaaactgcgaaaccggcattaccgcgacgccgtgcggcgtgtgcgataactgtcgtgaaatcgagcaggggcgctttgtcgatctgattgaaatcgacgccgcctcgcgcaccaaagttgaagatacccgcgacctgctggataacgtccagtacgctccggcgcgtggtcgtttcaaagtttatctgatcgacgaagtgcatatgctgtcgcgccacagctttaacgcactgttaaaaacccttgaagagccgccggagcacgttaagtttctgctggcgacgaccgatccacagaaattgccggtgacgattttgtcacgctgtctgcaatttcatctcaaggcgctggatgtcgagcaaattcgccatcagcttgagcacatcctcaacgaagaacatatcgctcacgagccgcgggcgctgcaattgctggcacgcgccgctgaaggcagcctgcgagatgccttaagtctgaccgaccaggcgattgccagcggtgacggccaggtttcaacccaggcggtcagtgcgatgctgggtacgcttgacgacgatcaggcgctgtcgctggttgaagcgatggtcgaggccaacggcgagcgcgtaatggcgctgattaatgaagccgctgcccgtggtatcgagtgggaagcgttgctggtggaaatgctcggcctgttgcatcgtattgcgatggtacaactttcgcctgctgcacttggcaacgacatggccgccatcgagctgcggatgcgtgaactggcgcgcaccataccgccgacggatattcagctttactatcagacgctgttgattggtcgcaaagaattaccgtatgcgccggaccgtcgcatgggcgttgagatgacgctgctgcgcgcgctggcattccatccgcgtatgccgctgcctgagccagaagtgccacgacagtcctttgcacccgtcgcgccaacggcagtaatgacgccaacccaggtgccgccgcaaccgcaatcagcgccgcagcaggcaccgactgtaccgctcccggaaaccaccagccaggtgctggcggcgcgccagcagttgcagcgcgtgcagggagcaaccaaagcaaaaaagagtgaaccggcagccgctacccgcgcgcggccggtgaataacgctgcgctggaaagactggcttcggtcaccgatcgcgttcaggcgcgtccggtgccatcggcgctggaaaaagcgccagccaaaaaagaagcgtatcgctggaaggcgaccactccggtgatgcagcaaaaagaagtggtcgccacgccgaaggcgctgaaaaaagcgctggaacatgaaaaaacgccggaactggcggcgaagctagcggcagaagccattgagcgcgacccgtgggcggcacaggtgagccaactttcgctaccaaaactggtcgaacaggtggcgttaaatgcctggaaagaggagagcgacaacgcagtatgtctgcatttgcgctcctctcagcggcatttgaacaaccgcggtgcacagcaaaaactggctgaagcgttgagcatgttaaaaggttcaacggttgaactgactatcgttgaagatgataatcccgcggtgcgtacgccgctgaaatggcgtcaggcgatatacgaagaaaaacttgcgcaggcgcgcgagtccattattgcggataataatattcagaccctgcgtcggttcttcgatgcggagctggatgaagaaagtatccgccccatttaaacttaattaacggcactcctcagccaagtcaaaagcctccgaccggaggcttttgactacatgcccatggcgtttacgccccgccctgccactcatcgcagtactgttgtaattcattaagcattctgccgacatggaagccatcacaaacggcatgatgaacctgaatcgccagcggcatcagcaccttgtcgccttgcgtataatatttgcccatagtgaaaacgggggcgaagaagttgtccatattggccacgtttaaatcaaaactggtgaaactcacccagggattggctgagacgaaaaacatattctcaataaaccctttagggaaataggccaggttttcaccgtaacacgccacatcttgcgaatatatgtgtagaaactgccggaaatcgtcgtggtattcactccagagcgatgaaaacgtttcagtttgctcatggaaaacggtgtaacaagggtgaacactatcccatatcaccagctcaccgtctttcattgccatacggaactccggatgagcattcatcaggcgggcaagaatgtgaataaaggccggataaaacttgtgcttatttttctttacggtctttaaaaaggccgtaatatccagctgaacggtctggttataggtacattgagcaactgactgaaatgcctcaaaatgttctttacgatgccattgggatatatcaacggtggtatatccagtgatttttttctccattttagcttccttagctcctgaaaatctcgataactcaaaaaatacgcccggtagtgatcttatttcattatggtgaaagttggaacctcttacgtgccaagccaaataggccgt

SEQ ID NO: 57 - DNA, 5705 bp, Artificial Sequence
  Synthetic Polynucleotide
cactcggtcgctacgctccgggcgtgagactgcggcgggcgctgcggacacatacaaagttacccacagattccgtggataagcaggggactaacatgtgaggcaaaacagcagggccgcgccggtggcgtttttccataggctccgccctcctgccagagttcacataaacagacgcttttccggtgcatctgtgggagccgtgaggctcaaccatgaatctgacagtacgggcgaaacccgacaggacttaaagatccccaccgtttccggcgggtcgctccctcttgcgctctcctgttccgaccctgccgtttaccggatacctgttccgcctttctcccttacgggaagtgtggcgctttctcatagctcacacactggtatctcggctcggtgtaggtcgttcgctccaagctgggctgtaagcaagaactccccgttcagcccgactgctgcgccttatccggtaactgttcacttgagtccaacccggaaaagcacggtaaaacgccactggcagcagccattggtaactgggagttcgcagaggatttgtttagctaaacacgcggttgctcttgaagtgtgcgccaaagtccggctacactggaaggacagatttggttgctgtgctctgcgaaagccagttaccacggttaagcagttccccaactgacttaaccttcgatcaaaccacctccccaggtggttttttcgtttacagggcaaaagattacgcgcagaaaaaaaggatctcaagaagatcctttgatcttttctactgaaccgctctagatttcagtgcaatttatctcttcaaatgtagcacctgaagtcagcccaggaggaagaggacattcggtcaaataaaacgaaaggctcagtcgaaagactgggcctttcgttttagacttagggaccctttatgacaacttgacggctacatcattcactttttcttcacaaccggcacggaactcgctcgggctggccccggtgcattttttaaatacccgcgagaaatagagttgatcgtcaaaaccaacattgcgaccgacggtggcgataggcatccgggtggtgctcaaaagcagcttcgcctggctgatacgttggtcctcgcgccagcttaagacgctaatccctaactgctggcggaaaagatgtgacagacgcgacggcgacaagcaaacatgctgtgcgacgctggcgatatcaaaattgctgtctgccaggtgatcgctgatgtactgacaagcctcgcgtacccgattatccatcggtggatggagcgactcgttaatcgcttccatgcgccgcagtaacaattgctcaagcagatttatcgccagcagctccgaatagcgcccttccccttgcccggcgttaatgatttgcccaaacaggtcgctgaaatgcggctggtgcgcttcatccgggcgaaagaaccccgtattggcaaatattgacggccagttaagccattcatgccagtaggcgcgcggacgaaagtaaacccactggtgataccattcgcgagcctccggatgacgaccgtagtgatgaatctctcctggcgggaacagcaaaatatcacccggtcggcaaacaaattctcgtccctgatttttcaccaccccctgaccgcgaatggtgagattgagaatataacctttcattcccagcggtcggtcgataaaaaaatcgagataaccgttggcctcaatcggcgttaaacccgccaccagatgggcattaaacgagtatcccggcagcaggggatcattttgcgcttcagccatacttttcatactcccaccattcagagaagaaaccaattgtccatattgcatcagacattgccgtcactgcgtcttttactggctcttctcgctaacccaaccggtaaccccgcttattaaaagcattctgtaacaaagcgggaccaaagccatgacaaaaacgcgtaacaaaagtgtctataatcacggcagaaaagtccacattgattatttgcacggcgtcacactttgctatgccatagcatttttatccataagattagcggatcctacctgacgctttttatcgcaactctctactgtttctccatacccgtttttttggacgcgtacaactcaagtctgacataaatgaccgctatgagcactgcaattacacgccagatcgttctcgctaccgcaaccaccggtatgaaccagattggtgcgcactatgaaggccacaagatcattgagattggtgccgttgaagtggtgaaccgtcgcctgacgggcaataacttccatgtttatctcaaacccgatcggctggtggatccggaagcctttggcgtacatggtattgccgatgaatttttgctcgataagcccacgtttgccgaagtagccgatgagttcatggactatattcgcggcgcggagttggtgatccataacgcagcgttcgatatcggctttatggactacgagttttcgttgcttaagcgcgatattccgaagaccaatactttctgtaaggtcaccgatagccttgcggtggcgaggaaaatgtttcccggtaagcgcaacagcctcgatgcgttatgtgctcgctacgaaatagataacagtaaacgaacgctgcacggggcattactcgatgcccagatccttgcggaagtttatctggcgatgaccggtggtcaaacgtcgatggcttttgcgatggaaggagagacacaacagcaacaaggtgaagcaacaattcagcgcattgtacgtcaggcaagtaagttacgcgttgtttttgcgacagatgaagagattgcagctcatgaagcccgtctcgatctggtgcagaagaaaggcggaagttgcctctggcgagcataatccaccttccagcgtttcagagcctgccaatgagttatcaggtcttagcccgaaaatggcgcccacaaacctttgctgacgtcgtcggccaggaacatgtgctgaccgcactggcgaacggcttgtcgttagggcgtattcatcatgcttatcttttttccggcacccgtggcgtcggaaaaacctctatcgcccgactgctggcgaaggggctaaactgcgaaaccggcattaccgcgacgccgtgcggcgtgtgcgataactgtcgtgaaatcgagcaggggcgctttgtcgatctgattgaaatcgacgccgcctcgcgcaccaaagttgaagatacccgcgacctgctggataacgtccagtacgctccggcgcgtgatcgtttcaaagtttatctgatcgacgaagtgcatatgctgtcgcgccacagctttaacgcactgttaaaaacccttgaagagccgccggagcacgttaagtttctgctggcgacgaccgatccacagaaattgccggtgacgattttgtcacgctgtctgcaatttcatctcaaggcgctggatgtcgagcaaattcgccatcagcttgagcacatcctcaacgaagaacatatcgctcacgagccgcgggcgctgcaattgctggcacgcgccgctgaaggcagcctgcgagatgccttaagtctgaccgaccaggcgattgccagcggtgacggccaggtttcaacccaggcggtcagtgcgatgctgggtacgcttgacgacgatcaggcgctgtcgctggttgaagcgatggtcgaggccaacggcgagcgcgtaatggcgctgattaatgaagccgctgcccgtggtatcgagtgggaagcgttgctggtggaaatgctcggcctgttgcatcgtattgcgatggtacaactttcgcctgctgcacttggcaacgacatggccgccatcgagctgcggatgcgtgaactggcgcgcaccataccgccgacggatattcagctttactatcagacgctgttgattggtcgcaaagaattaccgtatgcgccggaccgtcgcatgggcgttgagatgacgctgctgcgcgcgctggcattccatccgcgtatgccgctgcctgagccagaagtgccacgacagtcctttgcacccgtcgcgccaacggcagtaatgacgccaacccaggtgccgccgcaaccgcaatcagcgccgcagcaggcaccgactgtaccgctcccggaaaccaccagccaggtgctggcggcgcgccagcagttgcagcgcgtgcagggagcaaccaaagcaaaaaagagtgaaccggcagccgctacccgcgcgcggccggtgaataacgctgcgctggaaagactggcttcggtcaccgatcgcgttcaggcgcgtccggtgccatcggcgctggaaaaagcgccagccaaaaaagaagcgtatcgctggaaggcgaccactccggtgatgcagcaaaaagaagtggtcgccacgccgaaggcgctgaaaaaagcgctggaacatgaaaaaacgccggaactggcggcgaagctagcggcagaagccattgagcgcgacccgtgggcggcacaggtgagccaactttcgctaccaaaactggtcgaacaggtggcgttaaatgcctggaaagaggagagcgacaacgcagtatgtctgcatttgcgctcctctcagcggcatttgaacaaccgcggtgcacagcaaaaactggctgaagcgttgagcatgttaaaaggttcaacggttgaactgactatcgttgaagatgataatcccgcggtgcgtacgccgctggagtggcgtcaggcgatatacgaagaaaaacttgcgcaggcgcgcgagtccattattgcggataataatattcagaccctgcgtcggttcttcgatgcggagctggatgaagaaagtatccgccccatttaaacttaattaacggcactcctcagccaagtcaaaagcctccgaccggaggcttttgactacatgcccatggcgtttacgccccgccctgccactcatcgcagtactgttgtaattcattaagcattctgccgacatggaagccatcacaaacggcatgatgaacctgaatcgccagcggcatcagcaccttgtcgccttgcgtataatatttgcccatagtgaaaacgggggcgaagaagttgtccatattggccacgtttaaatcaaaactggtgaaactcacccagggattggctgagacgaaaaacatattctcaataaaccctttagggaaataggccaggttttcaccgtaacacgccacatcttgcgaatatatgtgtagaaactgccggaaatcgtcgtggtattcactccagagcgatgaaaacgtttcagtttgctcatggaaaacggtgtaacaagggtgaacactatcccatatcaccagctcaccgtctttcattgccatacggaactccggatgagcattcatcaggcgggcaagaatgtgaataaaggccggataaaacttgtgcttatttttctttacggtctttaaaaaggccgtaatatccagctgaacggtctggttataggtacattgagcaactgactgaaatgcctcaaaatgttctttacgatgccattgggatatatcaacggtggtatatccagtgatttttttctccattttagcttccttagctcctgaaaatctcgataactcaaaaaatacgcccggtagtgatcttatttcattatggtgaaagttggaacctcttacgtgccaagccaaataggccgt

SEQ ID NO: 58 - DNA, 6335 bp, Artificial Sequence
  Synthetic Polynucleotide
cactcggtcgctacgctccgggcgtgagactgcggcgggcgctgcggacacatacaaagttacccacagattccgtggataagcaggggactaacatgtgaggcaaaacagcagggccgcgccggtggcgtttttccataggctccgccctcctgccagagttcacataaacagacgcttttccggtgcatctgtgggagccgtgaggctcaaccatgaatctgacagtacgggcgaaacccgacaggacttaaagatccccaccgtttccggcgggtcgctccctcttgcgctctcctgttccgaccctgccgtttaccggatacctgttccgcctttctcccttacgggaagtgtggcgctttctcatagctcacacactggtatctcggctcggtgtaggtcgttcgctccaagctgggctgtaagcaagaactccccgttcagcccgactgctgcgccttatccggtaactgttcacttgagtccaacccggaaaagcacggtaaaacgccactggcagcagccattggtaactgggagttcgcagaggatttgtttagctaaacacgcggttgctcttgaagtgtgcgccaaagtccggctacactggaaggacagatttggttgctgtgctctgcgaaagccagttaccacggttaagcagttccccaactgacttaaccttcgatcaaaccacctccccaggtggttttttcgtttacagggcaaaagattacgcgcagaaaaaaaggatctcaagaagatcctttgatcttttctactgaaccgctctagatttcagtgcaatttatctcttcaaatgtagcacctgaagtcagcccaggaggaagaggacatccggtcaaataaaacgaaaggctcagtcgaaagactgggcctttcgttttagacttagggaccctttatgacaacttgacggctacatcattcactttttcttcacaaccggcacggaactcgctcgggctggccccggtgcattttttaaatacccgcgagaaatagagttgatcgtcaaaaccaacattgcgaccgacggtggcgataggcatccgggtggtgctcaaaagcagcttcgcctggctgatacgttggtcctcgcgccagcttaagacgctaatccctaactgctggcggaaaagatgtgacagacgcgacggcgacaagcaaacatgctgtgcgacgctggcgatatcaaaattgctgtctgccaggtgatcgctgatgtactgacaagcctcgcgtacccgattatccatcggtggatggagcgactcgttaatcgcttccatgcgccgcagtaacaattgctcaagcagatttatcgccagcagctccgaatagcgcccttccccttgcccggcgttaatgatttgcccaaacaggtcgctgaaatgcggctggtgcgcttcatccgggcgaaagaaccccgtattggcaaatattgacggccagttaagccattcatgccagtaggcgcgcggacgaaagtaaacccactggtgataccattcgcgagcctccggatgacgaccgtagtgatgaatctctcctggcgggaacagcaaaatatcacccggtcggcaaacaaattctcgtccctgatttttcaccaccccctgaccgcgaatggtgagattgagaatataacctttcattcccagcggtcggtcgataaaaaaatcgagataaccgttggcctcaatcggcgttaaacccgccaccagatgggcattaaacgagtatcccggcagcaggggatcattttgcgcttcagccatacttttcatactcccaccattcagagaagaaaccaattgtccatattgcatcagacattgccgtcactgcgtcttttactggctcttctcgctaacccaaccggtaaccccgcttattaaaagcattctgtaacaaagcgggaccaaagccatgacaaaaacgcgtaacaaaagtgtctataatcacggcagaaaagtccacattgattatttgcacggcgtcacactttgctatgccatagcatttttatccataagattagcggatcctacctgacgctttttatcgcaactctctactgtttctccatacccgtttttttggacgcgtacaactcaagtctgacataaatgaccgctatgagcactgcaattacacgccagatcgttctcgctaccgcaaccaccggtatgaaccagattggtgcgcactatgaaggccacaagatcattgagattggtgccgttgaagtggtgaaccgtcgcctgacgggcaataacttccatgtttatctcaaacccgatcggctggtggatccggaagcctttggcgtacatggtattgccgatgaatttttgctcgataagcccacgtttgccgaagtagccgatgagttcatggactatattcgcggcgcggagttggtgatccataacgcagcgttcgatatcggctttatggactacgagttttcgttgcttaagcgcgatattccgaagaccaatactttctgtaaggtcaccgatagccttgcggtggcgaggaaaatgtttcccggtaagcgcaacagcctcgatgcgttatgtgctcgctacgaaatagataacagtaaacgaacgctgcacggggcattactcgatgcccagatccttgcggaagtttatctggcgatgaccggtggtcaaacgtcgatggcttttgcgatggaaggagagacacaacagcaacaaggtgaagcaacaattcagcgcattgtacgtcaggcaagtaagttacgcgttgtttttgcgacagatgaagagattgcagctcatgaagcccgtctcgatctggtgcagaagaaaggcggaagttgcctctggcgagcataatttaatatcagggaaccggacataaccccatgagtgcaatagaaaatttcgacgcccatacgcccatgatgcagcagtatctcaggctgaaagcccagcatcccgagatcctgctgttttaccggatgggtgatttttatgaactgttttatgacgacgcaaaacgcgcgtcgcaactgctggatatttcactgaccaaacgcggtgcttcggcgggagagccgatcccgatggcggggattccctaccatgcggtggaaaactatctcgccaaactggtgaatcagggagagtccgttgccatctgcgaacaaattggcgatccggcgaccagcaaaggtccggttgagcgcaaagttgtgcgtatcgttacgccaggcaccatcagcgatgaagccctgttgcaggagcgtcaggacaacctgctggcggctatctggcaggacagcaaaggtttcggctacgcgacgctggatatcagttccgggcgttttcgcctgagcgaaccggctgaccgcgaaacgatggcggcagaactgcaacgcactaatcctgcggaactgctgtatgcagaagattttgctgaaatgtcgttaattgaaggccgtcgcggcctgcgccgtcgcccgctgtgggagtttgaaatcgacaccgcgcgccagcagttgaatctgcaatttgggacccgcgatctggtcggttttggcgtcgagaacgcgccgcgcggactttgtgctgccggttgtctgttgcagtatgcgaaagatacccaacgtacgactctgccgcatattcgttccatcaccatggaacgtgagcaggacagcatcattatggatgccgcgacgcgtcgtaatctggaaatcacccagaacctggcgggtggtgcggaaaatacgctggcttctgtgctcgactgcaccgtcacgccgatgggcagccgtatgctgaaacgctggctgcatatgccagtgcgcgatacccgcgtgttgcttgagcgccagcaaactattggcgcattgcaggatttcaccgccgggctacagccggtactgcgtcaggtcggcgacctggaacgtattctggcacgtctggctttacgaactgctcgcccacgcgatctggcccgtatgcgccacgctttccagcaactgccggagctgcgtgcgcagttagaaactgtcgatagtgcaccggtacaggcgctacgtgagaagatgggcgagtttgccgagctgcgcgatctgctggagcgagcaatcatcgacacaccgccggtgctggtacgcgacggtggtgttatcgcatcgggctataacgaagagctggatgagtggcgcgcgctggctgacggcgcgaccgattatctggagcgtctggaagtccgcgagcgtgaacgtaccggcctggacacgctgaaagttggctttaatgcggtgcacggctactacattcaaatcagccgtgggcaaagccatctggcacccatcaactacatgcgtcgccagacgctgaaaaacgccgagcgctacatcattccagagctaaaagagtacgaagataaagttctcacctcaaaaggcaaagcactggcactggaaaaacagctttatgaagagctgttcgacctgctgttgccgcatctggaagcgttgcaacagagcgcgagcgcgctggcggaactcgacgtgctggttaacctggcggaacgggcctataccctgaactacacctgcccgaccttcattgataaaccgggcattcgcattaccgaaggtcgccatccggtagttgaacaagtactgaatgagccatttatcgccaacccgctgaatctgtcgccgcagcgccgcatgttgatcatcaccggtccgaacatgggcggtaaaagtacctatatgcgccagaccgcactgattgcgctgatggcctacatcggcagctatgtaccggcacaaaaagtcgagattggacctatcgatcgcatctttacccgcgtaggcgcggcagatgacctggcgtccgggcgctcaacctttatggtggagatgactgaaaccgccaatattttacataacgccaccgaatacagtctggtgttaatggtggagatcgggcgtggaacgtccacctacgatggtctgtcgctggcgtgggcgtgcgcggaaaatctggcgaataagattaaggcattgacgttatttgctacccactatttcgagctgacccagttaccggagaaaatggaaggcgtcgctaacgtgcatctcgatgcactggagcacggcgacaccattgcctttatgcacagcgtgcaggatggcgcggcgagcaaaagctacggcctggcggttgcagctctggcaggcgtgccaaaagaggttattaagcgcgcacggcaaaagctgcgtgagctggaaagcatttcgccgaacgccgccgctacgcaagtggatggtacgcaaatgtctttgctgtcagtaccagaagaaacttcgcctgcggtcgaagctctggaaaatcttgatccggattcactcaccccgcgtcaggcgctggagtggatttatcgcttgaagagcctggtgtaaacttaattaacggcactcctcagccaagtcaaaagcctccgaccggaggcttttgactacatgcccatggcgtttacgccccgccctgccactcatcgcagtactgttgtaattcattaagcattctgccgacatggaagccatcacaaacggcatgatgaacctgaatcgccagcggcatcagcaccttgtcgccttgcgtataatatttgcccatagtgaaaacgggggcgaagaagttgtccatattggccacgtttaaatcaaaactggtgaaactcacccagggattggctgagacgaaaaacatattctcaataaaccctttagggaaataggccaggttttcaccgtaacacgccacatcttgcgaatatatgtgtagaaactgccggaaatcgtcgtggtattcactccagagcgatgaaaacgtttcagtttgctcatggaaaacggtgtaacaagggtgaacactatcccatatcaccagctcaccgtctttcattgccatacggaactccggatgagcattcatcaggcgggcaagaatgtgaataaaggccggataaaacttgtgcttatttttctttacggtctttaaaaaggccgtaatatccagctgaacggtctggttataggtacattgagcaactgactgaaatgcctcaaaatgttctttacgatgccattgggatatatcaacggtggtatatccagtgatttttttctccattttagcttccttagctcctgaaaatctcgataactcaaaaaatacgcccggtagtgatcttatttcattatggtgaaagttggaacctcttacgtgccaagccaaataggccgt

SEQ ID NO: 59 - DNA, 6335 bp, Artificial Sequence
  Synthetic Polynucleotide
cactcggtcgctacgctccgggcgtgagactgcggcgggcgctgcggacacatacaaagttacccacagattccgtggataagcaggggactaacatgtgaggcaaaacagcagggccgcgccggtggcgtttttccataggctccgccctcctgccagagttcacataaacagacgcttttccggtgcatctgtgggagccgtgaggctcaaccatgaatctgacagtacgggcgaaacccgacaggacttaaagatccccaccgtttccggcgggtcgctccctcttgcgctctcctgttccgaccctgccgtttaccggatacctgttccgcctttctcccttacgggaagtgtggcgctttctcatagctcacacactggtatctcggctcggtgtaggtcgttcgctccaagctgggctgtaagcaagaactccccgttcagcccgactgctgcgccttatccggtaactgttcacttgagtccaacccggaaaagcacggtaaaacgccactggcagcagccattggtaactgggagttcgcagaggatttgtttagctaaacacgcggttgctcttgaagtgtgcgccaaagtccggctacactggaaggacagatttggttgctgtgctctgcgaaagccagttaccacggttaagcagttccccaactgacttaaccttcgatcaaaccacctccccaggtggttttttcgtttacagggcaaaagattacgcgcagaaaaaaaggatctcaagaagatcctttgatcttttctactgaaccgctctagatttcagtgcaatttatctcttcaaatgtagcacctgaagtcagcccaggaggaagaggacatccggtcaaataaaacgaaaggctcagtcgaaagactgggcctttcgttttagacttagggaccctttatgacaacttgacggctacatcattcactttttcttcacaaccggcacggaactcgctcgggctggccccggtgcattttttaaatacccgcgagaaatagagttgatcgtcaaaaccaacattgcgaccgacggtggcgataggcatccgggtggtgctcaaaagcagcttcgcctggctgatacgttggtcctcgcgccagcttaagacgctaatccctaactgctggcggaaaagatgtgacagacgcgacggcgacaagcaaacatgctgtgcgacgctggcgatatcaaaattgctgtctgccaggtgatcgctgatgtactgacaagcctcgcgtacccgattatccatcggtggatggagcgactcgttaatcgcttccatgcgccgcagtaacaattgctcaagcagatttatcgccagcagctccgaatagcgcccttccccttgcccggcgttaatgatttgcccaaacaggtcgctgaaatgcggctggtgcgcttcatccgggcgaaagaaccccgtattggcaaatattgacggccagttaagccattcatgccagtaggcgcgcggacgaaagtaaacccactggtgataccattcgcgagcctccggatgacgaccgtagtgatgaatctctcctggcgggaacagcaaaatatcacccggtcggcaaacaaattctcgtccctgatttttcaccaccccctgaccgcgaatggtgagattgagaatataacctttcattcccagcggtcggtcgataaaaaaatcgagataaccgttggcctcaatcggcgttaaacccgccaccagatgggcattaaacgagtatcccggcagcaggggatcattttgcgcttcagccatacttttcatactcccaccattcagagaagaaaccaattgtccatattgcatcagacattgccgtcactgcgtcttttactggctcttctcgctaacccaaccggtaaccccgcttattaaaagcattctgtaacaaagcgggaccaaagccatgacaaaaacgcgtaacaaaagtgtctataatcacggcagaaaagtccacattgattatttgcacggcgtcacactttgctatgccatagcatttttatccataagattagcggatcctacctgacgctttttatcgcaactctctactgtttctccatacccgtttttttggacgcgtacaactcaagtctgacataaatgaccgctatgagcactgcaattacacgccagatcgttctcgctaccgcaaccaccggtatgaaccagattggtgcgcactatgaaggccacaagatcattgagattggtgccgttgaagtggtgaaccgtcgcctgacgggcaataacttccatgtttatctcaaacccgatcggctggtggatccggaagcctttggcgtacatggtattgccgatgaatttttgctcgataagcccacgtttgccgaagtagccgatgagttcatggactatattcgcggcgcggagttggtgatccataacgcagcgttcgatatcggctttatggactacgagttttcgttgcttaagcgcgatattccgaagaccaatactttctgtaaggtcaccgatagccttgcggtggcgaggaaaatgtttcccggtaagcgcaacagcctcgatgcgttatgtgctcgctacgaaatagataacagtaaacgaacgctgcacggggcattactcgatgcccagatccttgcggaagtttatctggcgatgaccggtggtcaaacgtcgatggcttttgcgatggaaggagagacacaacagcaacaaggtgaagcaacaattcagcgcattgtacgtcaggcaagtaagttacgcgttgtttttgcgacagatgaagagattgcagctcatgaagcccgtctcgatctggtgcagaagaaaggcggaagttgcctctggcgagcataatttaatatcagggaaccggacataaccccatgagtgcaatagaaaatttcgacgcccatacgcccatgatgcagcagtatctcaggctgaaagcccagcatcccgagatcctgctgttttaccggatgggtgatttttatgaactgttttatgacgacgcaaaacgcgcgtcgcaactgctggatatttcactgaccaaacgcggtgcttcggcgggagagccgatcccgatggcggggattccctaccatgcggtggaaaactatctcgccaaactggtgaatcagggagagtccgttgccatctgcgaacaaattggcgatccggcgaccagcaaaggtccggttgagcgcaaagttgtgcgtatcgttacgccaggcaccatcagcgatgaagccctgttgcaggagcgtcaggacaacctgctggcggctatctggcaggacagcaaaggtttcggctacgcgacgctggatatcagttccgggcgttttcgcctgagcgaaccggctgaccgcgaaacgatggcggcagaactgcaacgcactaatcctgcggaactgctgtatgcagaagattttgctgaaatgtcgttaattgaaggccgtcgcggcctgcgccgtcgcccgctgtgggagtttgaaatcgacaccgcgcgccagcagttgaatctgcaatttgggacccgcgatctggtcggttttggcgtcgagaacgcgccgcgcggactttgtgctgccggttgtctgttgcagtatgcgaaagatacccaacgtacgactctgccgcatattcgttccatcaccatggaacgtgagcaggacagcatcattatggatgccgcgacgcgtcgtaatctggaaatcacccagaacctggcgggtggtgcggaaaatacgctggcttctgtgctcgactgcaccgtcacgccgatgggcagccgtatgctgaaacgctggctgcatatgccagtgcgcgatacccgcgtgttgcttgagcgccagcaaactattggcgcattgcaggatttcaccgccgggctacagccggtactgcgtcaggtcggcgacctggaacgtattctggcacgtctggctttacgaactgctcgcccacgcgatctggcccgtatgcgccacgctttccagcaactgccggagctgcgtgcgcagttagaaactgtcgatagtgcaccggtacaggcgctacgtgagaagatgggcgagtttgccgagctgcgcgatctgctggagcgagcaatcatcgacacaccgccggtgctggtacgcgacggtggtgttatcgcatcgggctataacgaagagctggatgagtggcgcgcgctggctgacggcgcgaccgattatctggagcgtctggaagtccgcgagcgtgaacgtaccggcctggacacgctgaaagttggctttaatgcggtgcacggctactacattcaaatcagccgtgggcaaagccatctggcacccatcaactacatgcgtcgccagacgctgaaaaacgccgagcgctacatcattccagagctaaaagagtacgaagataaagttctcacctcaaaaggcaaagcactggcactggaaaaacagctttatgaagagctgttcgacctgctgttgccgcatctggaagcgttgcaacagagcgcgagcgcgctggcggaactcgacgtgctggttaacctggcggaacgggcctataccctgaactacacctgcccgaccttcattgataaaccgggcattcgcattaccgaaggtcgccatccggtagttgaacaagtactgaatgagccatttatcgccaacccgctgaatctgtcgccgcagcgccgcatgttgatcatcaccggtccgaacatgggcggtaaaagtacctatatgcgccagaccgcactgattgcgctgatggcctacatcggcagctatgtaccggcacaaaaagtcgagattggacctatcgatcgcatctttacccgcgtaggcgcggcagatgacctggcgtccgggcgctcaacctttatggtggagatgactgaaaccgccaatattttacataacgccaccgaatacagtctggtgttaatggatcagatcgggcgtggaacgtccacctacgatggtctgtcgctggcgtgggcgtgcgcggaaaatctggcgaataagattaaggcattgacgttatttgctacccactatttcgagctgacccagttaccggagaaaatggaaggcgtcgctaacgtgcatctcgatgcactggagcacggcgacaccattgcctttatgcacagcgtgcaggatggcgcggcgagcaaaagctacggcctggcggttgcagctctggcaggcgtgccaaaagaggttattaagcgcgcacggcaaaagctgcgtgagctggaaagcatttcgccgaacgccgccgctacgcaagtggatggtacgcaaatgtctttgctgtcagtaccagaagaaacttcgcctgcggtcgaagctctggaaaatcttgatccggattcactcaccccgcgtcaggcgctggagtggatttatcgcttgaagagcctggtgtaaacttaattaacggcactcctcagccaagtcaaaagcctccgaccggaggcttttgactacatgcccatggcgtttacgccccgccctgccactcatcgcagtactgttgtaattcattaagcattctgccgacatggaagccatcacaaacggcatgatgaacctgaatcgccagcggcatcagcaccttgtcgccttgcgtataatatttgcccatagtgaaaacgggggcgaagaagttgtccatattggccacgtttaaatcaaaactggtgaaactcacccagggattggctgagacgaaaaacatattctcaataaaccctttagggaaataggccaggttttcaccgtaacacgccacatcttgcgaatatatgtgtagaaactgccggaaatcgtcgtggtattcactccagagcgatgaaaacgtttcagtttgctcatggaaaacggtgtaacaagggtgaacactatcccatatcaccagctcaccgtctttcattgccatacggaactccggatgagcattcatcaggcgggcaagaatgtgaataaaggccggataaaacttgtgcttatttttctttacggtctttaaaaaggccgtaatatccagctgaacggtctggttataggtacattgagcaactgactgaaatgcctcaaaatgttctttacgatgccattgggatatatcaacggtggtatatccagtgatttttttctccattttagcttccttagctcctgaaaatctcgataactcaaaaaatacgcccggtagtgatcttatttcattatggtgaaagttggaacctcttacgtgccaagccaaataggccgt

SEQ ID NO: 60 - DNA, 5621 bp, Artificial Sequence
  Synthetic Polynucleotide
cactcggtcgctacgctccgggcgtgagactgcggcgggcgctgcggacacatacaaagttacccacagattccgtggataagcaggggactaacatgtgaggcaaaacagcagggccgcgccggtggcgtttttccataggctccgccctcctgccagagttcacataaacagacgcttttccggtgcatctgtgggagccgtgaggctcaaccatgaatctgacagtacgggcgaaacccgacaggacttaaagatccccaccgtttccggcgggtcgctccctcttgcgctctcctgttccgaccctgccgtttaccggatacctgttccgcctttctcccttacgggaagtgtggcgctttctcatagctcacacactggtatctcggctcggtgtaggtcgttcgctccaagctgggctgtaagcaagaactccccgttcagcccgactgctgcgccttatccggtaactgttcacttgagtccaacccggaaaagcacggtaaaacgccactggcagcagccattggtaactgggagttcgcagaggatttgtttagctaaacacgcggttgctcttgaagtgtgcgccaaagtccggctacactggaaggacagatttggttgctgtgctctgcgaaagccagttaccacggttaagcagttccccaactgacttaaccttcgatcaaaccacctccccaggtggttttttcgtttacagggcaaaagattacgcgcagaaaaaaaggatctcaagaagatcctttgatcttttctactgaaccgctctagatttcagtgcaatttatctcttcaaatgtagcacctgaagtcagcccaggaggaagaggacatccggtcaaataaaacgaaaggctcagtcgaaagactgggcctttcgttttagacttagggaccctttatgacaacttgacggctacatcattcactttttcttcacaaccggcacggaactcgctcgggctggccccggtgcattttttaaatacccgcgagaaatagagttgatcgtcaaaaccaacattgcgaccgacggtggcgataggcatccgggtggtgctcaaaagcagcttcgcctggctgatacgttggtcctcgcgccagcttaagacgctaatccctaactgctggcggaaaagatgtgacagacgcgacggcgacaagcaaacatgctgtgcgacgctggcgatatcaaaattgctgtctgccaggtgatcgctgatgtactgacaagcctcgcgtacccgattatccatcggtggatggagcgactcgttaatcgcttccatgcgccgcagtaacaattgctcaagcagatttatcgccagcagctccgaatagcgcccttccccttgcccggcgttaatgatttgcccaaacaggtcgctgaaatgcggctggtgcgcttcatccgggcgaaagaaccccgtattggcaaatattgacggccagttaagccattcatgccagtaggcgcgcggacgaaagtaaacccactggtgataccattcgcgagcctccggatgacgaccgtagtgatgaatctctcctggcgggaacagcaaaatatcacccggtcggcaaacaaattctcgtccctgatttttcaccaccccctgaccgcgaatggtgagattgagaatataacctttcattcccagcggtcggtcgataaaaaaatcgagataaccgttggcctcaatcggcgttaaacccgccaccagatgggcattaaacgagtatcccggcagcaggggatcattttgcgcttcagccatacttttcatactcccaccattcagagaagaaaccaattgtccatattgcatcagacattgccgtcactgcgtcttttactggctcttctcgctaacccaaccggtaaccccgcttattaaaagcattctgtaacaaagcgggaccaaagccatgacaaaaacgcgtaacaaaagtgtctataatcacggcagaaaagtccacattgattatttgcacggcgtcacactttgctatgccatagcatttttatccataagattagcggatcctacctgacgctttttatcgcaactctctactgtttctccatacccgtttttttggacgcgtacaactcaagtctgacataaatgaccgctatgagcactgcaattacacgccagatcgttctcgctaccgcaaccaccggtatgaaccagattggtgcgcactatgaaggccacaagatcattgagattggtgccgttgaagtggtgaaccgtcgcctgacgggcaataacttccatgtttatctcaaacccgatcggctggtggatccggaagcctttggcgtacatggtattgccgatgaatttttgctcgataagcccacgtttgccgaagtagccgatgagttcatggactatattcgcggcgcggagttggtgatccataacgcagcgttcgatatcggctttatggactacgagttttcgttgcttaagcgcgatattccgaagaccaatactttctgtaaggtcaccgatagccttgcggtggcgaggaaaatgtttcccggtaagcgcaacagcctcgatgcgttatgtgctcgctacgaaatagataacagtaaacgaacgctgcacggggcattactcgatgcccagatccttgcggaagtttatctggcgatgaccggtggtcaaacgtcgatggcttttgcgatggaaggagagacacaacagcaacaaggtgaagcaacaattcagcgcattgtacgtcaggcaagtaagttacgcgttgtttttgcgacagatgaagagattgcagctcatgaagcccgtctcgatctggtgcagaagaaaggcggaagttgcctctggcgagcataaatcgcacgctgccaaactaaggacgattgatgccaattcaggtcttaccgccacaactggcgaaccagattgccgcaggtgaggtggtcgagcgacctgcgtcggtagtcaaagaactagtgaaaaacagcctcgatgcaggtgcgacgcgtatcgatattgatatcgaacgcggtggggcgaaacttatccgcattcgtgataacggctgcggtatcaaaaaagatgagctggcgctggcgctggctcgtcatgccaccagtaaaatcgcctctctggacgatctcgaagccattatcagcctgggctttcgcggtgaggcgctggcgagtatcagttcggtttcccgcctgacgctcacttcacgcaccgcagaacagcaggaagcctggcaggcctatgccgaagggcgcgatatgaacgtgacggtaaaaccggcggcgcatcctgtggggacgacgctggaggtgctggatctgttctacaacaccccggcgcggcgcaaattcctgcgcaccgagaaaaccgaatttaaccacattgatgagatcatccgccgcattgcgctggcgcgtttcgacgtcacgatcaacctgtcgcataacggtaaaattgtgcgtcagtaccgcgcagtgccggaaggcgggcaaaaagaacggcgcttaggcgcgatttgcggcaccgcttttcttgaacaagcgctggcgattgaatggcaacacggcgatctcacgctacgcggctgggtggccgatccaaatcacaccacgcccgcactggcagaaattcagtattgctacgtgaacggtcgcatgatgcgcgatcgcctgatcaatcacgcgatccgccaggcctgcgaagacaaactgggggccgatcagcaaccggcatttgtgttgtatctggagatcgacccacatcaggtggacgtcaacgtgcaccccgccaaacacgaagtgcgtttccatcagtcgcgtctggtgcatgattttatctatcagggcgtgctgagcgtgctacaacagcaactggaaacgccgctaccgctggacgatgaaccccaacctgcaccgcgttccattccggaaaaccgcgtggcggcggggcgcaatcactttgcagaaccggcagctcgtgagccggtagctccgcgctacactcctgcgccagcatcaggcagtcgtccggctgccccctggccgaatgcgcagccaggctaccagaaacagcaaggtgaagtgtatcgccagcttttgcaaacgcccgcgccgatgcaaaaattaaaagcgccggaaccgcaggaacctgcacttgcggcgaacagtcagagttttggtcgggtactgactatcgtccattccgactgtgcgttgctggagcgcgacggcaacatttcacttttatccttgccagtggcagaacgttggctgcgtcaggcacaattgacgccgggtgaagcgcccgtttgcgcccagccgctgctgattccgttgcggctaaaagtttctgccgaagaaaaatcggcattagaaaaagcgcagtctgccctggcggaattgggtattgatttccagtcagatgcacagcatgtgaccatcagggcagtgcctttacccttacgccaacaaaatttacaaatcttgattcctgaactgataggctacctggcgaagcagtccgtattcgaacctggcaatattgcgcagtggattgcacgaaatctgatgagcgaacatgcgcagtggtcaatggcacaggccataaccctgctggcggacgtggaacggttatgtccgcaacttgtgaaaacgccgccgggtggtctgttacaatctgttgatttacatccggcgataaaagccctgaaagatgagtgaacttaattaacggcactcctcagccaagtcaaaagcctccgaccggaggcttttgactacatgcccatggcgtttacgccccgccctgccactcatcgcagtactgttgtaattcattaagcattctgccgacatggaagccatcacaaacggcatgatgaacctgaatcgccagcggcatcagcaccttgtcgccttgcgtataatatttgcccatagtgaaaacgggggcgaagaagttgtccatattggccacgtttaaatcaaaactggtgaaactcacccagggattggctgagacgaaaaacatattctcaataaaccctttagggaaataggccaggttttcaccgtaacacgccacatcttgcgaatatatgtgtagaaactgccggaaatcgtcgtggtattcactccagagcgatgaaaacgtttcagtttgctcatggaaaacggtgtaacaagggtgaacactatcccatatcaccagctcaccgtctttcattgccatacggaactccggatgagcattcatcaggcgggcaagaatgtgaataaaggccggataaaacttgtgcttatttttctttacggtctttaaaaaggccgtaatatccagctgaacggtctggttataggtacattgagcaactgactgaaatgcctcaaaatgttctttacgatgccattgggatatatcaacggtggtatatccagtgatttttttctccattttagcttccttagctcctgaaaatctcgataactcaaaaaatacgcccggtagtgatcttatttcattatggtgaaagttggaacctcttacgtgccaagccaaataggccgt

SEQ ID NO: 61 - DNA, 5621 bp, Artificial Sequence
  Synthetic Polynucleotide
cactcggtcgctacgctccgggcgtgagactgcggcgggcgctgcggacacatacaaagttacccacagattccgtggataagcaggggactaacatgtgaggcaaaacagcagggccgcgccggtggcgtttttccataggctccgccctcctgccagagttcacataaacagacgcttttccggtgcatctgtgggagccgtgaggctcaaccatgaatctgacagtacgggcgaaacccgacaggacttaaagatccccaccgtttccggcgggtcgctccctcttgcgctctcctgttccgaccctgccgtttaccggatacctgttccgcctttctcccttacgggaagtgtggcgctttctcatagctcacacactggtatctcggctcggtgtaggtcgttcgctccaagctgggctgtaagcaagaactccccgttcagcccgactgctgcgccttatccggtaactgttcacttgagtccaacccggaaaagcacggtaaaacgccactggcagcagccattggtaactgggagttcgcagaggatttgtttagctaaacacgcggttgctcttgaagtgtgcgccaaagtccggctacactggaaggacagatttggttgctgtgctctgcgaaagccagttaccacggttaagcagttccccaactgacttaaccttcgatcaaaccacctccccaggtggttttttcgtttacagggcaaaagattacgcgcagaaaaaaaggatctcaagaagatcctttgatcttttctactgaaccgctctagatttcagtgcaatttatctcttcaaatgtagcacctgaagtcagcccaggaggaagaggacatccggtcaaataaaacgaaaggctcagtcgaaagactgggcctttcgttttagacttagggaccctttatgacaacttgacggctacatcattcactttttcttcacaaccggcacggaactcgctcgggctggccccggtgcattttttaaatacccgcgagaaatagagttgatcgtcaaaaccaacattgcgaccgacggtggcgataggcatccgggtggtgctcaaaagcagcttcgcctggctgatacgttggtcctcgcgccagcttaagacgctaatccctaactgctggcggaaaagatgtgacagacgcgacggcgacaagcaaacatgctgtgcgacgctggcgatatcaaaattgctgtctgccaggtgatcgctgatgtactgacaagcctcgcgtacccgattatccatcggtggatggagcgactcgttaatcgcttccatgcgccgcagtaacaattgctcaagcagatttatcgccagcagctccgaatagcgcccttccccttgcccggcgttaatgatttgcccaaacaggtcgctgaaatgcggctggtgcgcttcatccgggcgaaagaaccccgtattggcaaatattgacggccagttaagccattcatgccagtaggcgcgcggacgaaagtaaacccactggtgataccattcgcgagcctccggatgacgaccgtagtgatgaatctctcctggcgggaacagcaaaatatcacccggtcggcaaacaaattctcgtccctgatttttcaccaccccctgaccgcgaatggtgagattgagaatataacctttcattcccagcggtcggtcgataaaaaaatcgagataaccgttggcctcaatcggcgttaaacccgccaccagatgggcattaaacgagtatcccggcagcaggggatcattttgcgcttcagccatacttttcatactcccaccattcagagaagaaaccaattgtccatattgcatcagacattgccgtcactgcgtcttttactggctcttctcgctaacccaaccggtaaccccgcttattaaaagcattctgtaacaaagcgggaccaaagccatgacaaaaacgcgtaacaaaagtgtctataatcacggcagaaaagtccacattgattatttgcacggcgtcacactttgctatgccatagcatttttatccataagattagcggatcctacctgacgctttttatcgcaactctctactgtttctccatacccgtttttttggacgcgtacaactcaagtctgacataaatgaccgctatgagcactgcaattacacgccagatcgttctcgctaccgcaaccaccggtatgaaccagattggtgcgcactatgaaggccacaagatcattgagattggtgccgttgaagtggtgaaccgtcgcctgacgggcaataacttccatgtttatctcaaacccgatcggctggtggatccggaagcctttggcgtacatggtattgccgatgaatttttgctcgataagcccacgtttgccgaagtagccgatgagttcatggactatattcgcggcgcggagttggtgatccataacgcagcgttcgatatcggctttatggactacgagttttcgttgcttaagcgcgatattccgaagaccaatactttctgtaaggtcaccgatagccttgcggtggcgaggaaaatgtttcccggtaagcgcaacagcctcgatgcgttatgtgctcgctacgaaatagataacagtaaacgaacgctgcacggggcattactcgatgcccagatccttgcggaagtttatctggcgatgaccggtggtcaaacgtcgatggcttttgcgatggaaggagagacacaacagcaacaaggtgaagcaacaattcagcgcattgtacgtcaggcaagtaagttacgcgttgtttttgcgacagatgaagagattgcagctcatgaagcccgtctcgatctggtgcagaagaaaggcggaagttgcctctggcgagcataaatcgcacgctgccaaactaaggacgattgatgccaattcaggtcttaccgccacaactggcgaaccagattgccgcaggtgaggtggtcgagcgacctgcgtcggtagtcaaagaactagtggaaaacagcctcgatgcaggtgcgacgcgtatcgatattgatatcgaacgcggtggggcgaaacttatccgcattcgtgataacggctgcggtatcaaaaaagatgagctggcgctggcgctggctcgtcatgccaccagtaaaatcgcctctctggacgatctcgaagccattatcagcctgggctttcgcgatgaggcgctggcgagtatcagttcggtttcccgcctgacgctcacttcacgcaccgcagaacagcaggaagcctggcaggcctatgccgaagggcgcgatatgaacgtgacggtaaaaccggcggcgcatcctgtggggacgacgctggaggtgctggatctgttctacaacaccccggcgcggcgcaaattcctgcgcaccgagaaaaccgaatttaaccacattgatgagatcatccgccgcattgcgctggcgcgtttcgacgtcacgatcaacctgtcgcataacggtaaaattgtgcgtcagtaccgcgcagtgccggaaggcgggcaaaaagaacggcgcttaggcgcgatttgcggcaccgcttttcttgaacaagcgctggcgattgaatggcaacacggcgatctcacgctacgcggctgggtggccgatccaaatcacaccacgcccgcactggcagaaattcagtattgctacgtgaacggtcgcatgatgcgcgatcgcctgatcaatcacgcgatccgccaggcctgcgaagacaaactgggggccgatcagcaaccggcatttgtgttgtatctggagatcgacccacatcaggtggacgtcaacgtgcaccccgccaaacacgaagtgcgtttccatcagtcgcgtctggtgcatgattttatctatcagggcgtgctgagcgtgctacaacagcaactggaaacgccgctaccgctggacgatgaaccccaacctgcaccgcgttccattccggaaaaccgcgtggcggcggggcgcaatcactttgcagaaccggcagctcgtgagccggtagctccgcgctacactcctgcgccagcatcaggcagtcgtccggctgccccctggccgaatgcgcagccaggctaccagaaacagcaaggtgaagtgtatcgccagcttttgcaaacgcccgcgccgatgcaaaaattaaaagcgccggaaccgcaggaacctgcacttgcggcgaacagtcagagttttggtcgggtactgactatcgtccattccgactgtgcgttgctggagcgcgacggcaacatttcacttttatccttgccagtggcagaacgttggctgcgtcaggcacaattgacgccgggtgaagcgcccgtttgcgcccagccgctgctgattccgttgcggctaaaagtttctgccgaagaaaaatcggcattagaaaaagcgcagtctgccctggcggaattgggtattgatttccagtcagatgcacagcatgtgaccatcagggcagtgcctttacccttacgccaacaaaatttacaaatcttgattcctgaactgataggctacctggcgaagcagtccgtattcgaacctggcaatattgcgcagtggattgcacgaaatctgatgagcgaacatgcgcagtggtcaatggcacaggccataaccctgctggcggacgtggaacggttatgtccgcaacttgtgaaaacgccgccgggtggtctgttacaatctgttgatttacatccggcgataaaagccctgaaagatgagtgaacttaattaacggcactcctcagccaagtcaaaagcctccgaccggaggcttttgactacatgcccatggcgtttacgccccgccctgccactcatcgcagtactgttgtaattcattaagcattctgccgacatggaagccatcacaaacggcatgatgaacctgaatcgccagcggcatcagcaccttgtcgccttgcgtataatatttgcccatagtgaaaacgggggcgaagaagttgtccatattggccacgtttaaatcaaaactggtgaaactcacccagggattggctgagacgaaaaacatattctcaataaaccctttagggaaataggccaggttttcaccgtaacacgccacatcttgcgaatatatgtgtagaaactgccggaaatcgtcgtggtattcactccagagcgatgaaaacgtttcagtttgctcatggaaaacggtgtaacaagggtgaacactatcccatatcaccagctcaccgtctttcattgccatacggaactccggatgagcattcatcaggcgggcaagaatgtgaataaaggccggataaaacttgtgcttatttttctttacggtctttaaaaaggccgtaatatccagctgaacggtctggttataggtacattgagcaactgactgaaatgcctcaaaatgttctttacgatgccattgggatatatcaacggtggtatatccagtgatttttttctccattttagcttccttagctcctgaaaatctcgataactcaaaaaatacgcccggtagtgatcttatttcattatggtgaaagttggaacctcttacgtgccaagccaaataggccgt

SEQ ID NO: 62 - DNA, 5621 bp, Artificial Sequence
  Synthetic Polynucleotide
cactcggtcgctacgctccgggcgtgagactgcggcgggcgctgcggacacatacaaagttacccacagattccgtggataagcaggggactaacatgtgaggcaaaacagcagggccgcgccggtggcgtttttccataggctccgccctcctgccagagttcacataaacagacgcttttccggtgcatctgtgggagccgtgaggctcaaccatgaatctgacagtacgggcgaaacccgacaggacttaaagatccccaccgtttccggcgggtcgctccctcttgcgctctcctgttccgaccctgccgtttaccggatacctgttccgcctttctcccttacgggaagtgtggcgctttctcatagctcacacactggtatctcggctcggtgtaggtcgttcgctccaagctgggctgtaagcaagaactccccgttcagcccgactgctgcgccttatccggtaactgttcacttgagtccaacccggaaaagcacggtaaaacgccactggcagcagccattggtaactgggagttcgcagaggatttgtttagctaaacacgcggttgctcttgaagtgtgcgccaaagtccggctacactggaaggacagatttggttgctgtgctctgcgaaagccagttaccacggttaagcagttccccaactgacttaaccttcgatcaaaccacctccccaggtggttttttcgtttacagggcaaaagattacgcgcagaaaaaaaggatctcaagaagatcctttgatcttttctactgaaccgctctagatttcagtgcaatttatctcttcaaatgtagcacctgaagtcagcccaggaggaagaggacatccggtcaaataaaacgaaaggctcagtcgaaagactgggcctttcgttttagacttagggaccctttatgacaacttgacggctacatcattcactttttcttcacaaccggcacggaactcgctcgggctggccccggtgcattttttaaatacccgcgagaaatagagttgatcgtcaaaaccaacattgcgaccgacggtggcgataggcatccgggtggtgctcaaaagcagcttcgcctggctgatacgttggtcctcgcgccagcttaagacgctaatccctaactgctggcggaaaagatgtgacagacgcgacggcgacaagcaaacatgctgtgcgacgctggcgatatcaaaattgctgtctgccaggtgatcgctgatgtactgacaagcctcgcgtacccgattatccatcggtggatggagcgactcgttaatcgcttccatgcgccgcagtaacaattgctcaagcagatttatcgccagcagctccgaatagcgcccttccccttgcccggcgttaatgatttgcccaaacaggtcgctgaaatgcggctggtgcgcttcatccgggcgaaagaaccccgtattggcaaatattgacggccagttaagccattcatgccagtaggcgcgcggacgaaagtaaacccactggtgataccattcgcgagcctccggatgacgaccgtagtgatgaatctctcctggcgggaacagcaaaatatcacccggtcggcaaacaaattctcgtccctgatttttcaccaccccctgaccgcgaatggtgagattgagaatataacctttcattcccagcggtcggtcgataaaaaaatcgagataaccgttggcctcaatcggcgttaaacccgccaccagatgggcattaaacgagtatcccggcagcaggggatcattttgcgcttcagccatacttttcatactcccaccattcagagaagaaaccaattgtccatattgcatcagacattgccgtcactgcgtcttttactggctcttctcgctaacccaaccggtaaccccgcttattaaaagcattctgtaacaaagcgggaccaaagccatgacaaaaacgcgtaacaaaagtgtctataatcacggcagaaaagtccacattgattatttgcacggcgtcacactttgctatgccatagcatttttatccataagattagcggatcctacctgacgctttttatcgcaactctctactgtttctccatacccgtttttttggacgcgtacaactcaagtctgacataaatgaccgctatgagcactgcaattacacgccagatcgttctcgctaccgcaaccaccggtatgaaccagattggtgcgcactatgaaggccacaagatcattgagattggtgccgttgaagtggtgaaccgtcgcctgacgggcaataacttccatgtttatctcaaacccgatcggctggtggatccggaagcctttggcgtacatggtattgccgatgaatttttgctcgataagcccacgtttgccgaagtagccgatgagttcatggactatattcgcggcgcggagttggtgatccataacgcagcgttcgatatcggctttatggactacgagttttcgttgcttaagcgcgatattccgaagaccaatactttctgtaaggtcaccgatagccttgcggtggcgaggaaaatgtttcccggtaagcgcaacagcctcgatgcgttatgtgctcgctacgaaatagataacagtaaacgaacgctgcacggggcattactcgatgcccagatccttgcggaagtttatctggcgatgaccggtggtcaaacgtcgatggcttttgcgatggaaggagagacacaacagcaacaaggtgaagcaacaattcagcgcattgtacgtcaggcaagtaagttacgcgttgtttttgcgacagatgaagagattgcagctcatgaagcccgtctcgatctggtgcagaagaaaggcggaagttgcctctggcgagcataaatcgcacgctgccaaactaaggacgattgatgccaattcaggtcttaccgccacaactggcgaaccagattgccgcaggtgaggtggtcgagcgacctgcgtcggtagtcaaagaactagtggaaaacagcctcgatgcaggtgcgacgcgtatcgatattgatatcgaacgcggtggggcgaaacttatccgcattcgtgataacggctgcggtatcaaaaaagatgagctggcgctggcgctggctcgtcatgccaccagtaaaatcgcctctctggacgatctcgaagccattatcagcctgggctttcgcggtgaggcgctggcgagtatcagttcggtttcccgcctgacgctcacttcacgcaccgcagaacagcaggaagcctggcaggcctatgccgaagggcgcgatatgaacgtgacggtaaaaccggcggcgcatcctgtggggacgacgctggaggtgctggatctgttctacaacaccccggcgcggcgcaaattcctgcgcaccgagaaaaccgaatttaaccacattgatgagatcatccgccgcattgcgctggcgcgtttcgacgtcacgatcaacctgtcgcataacggtaaaattgtgcgtcagtaccgcgcagtgccggaaggcgggcaaaaagaacggcgcttaggcgcgatttgcggcaccgcttttcttgaacaagcgctggcgattgaatggcaacacggcgatctcacgctacgcggctgggtggccgatccaaatcacaccacgcccgcactggcagaaattcagtattgctacgtgaacggtcatatgatgcgcgatcgcctgatcaatcacgcgatccgccaggcctgcgaagacaaactgggggccgatcagcaaccggcatttgtgttgtatctggagatcgacccacatcaggtggacgtcaacgtgcaccccgccaaacacgaagtgcgtttccatcagtcgcgtctggtgcatgattttatctatcagggcgtgctgagcgtgctacaacagcaactggaaacgccgctaccgctggacgatgaaccccaacctgcaccgcgttccattccggaaaaccgcgtggcggcggggcgcaatcactttgcagaaccggcagctcgtgagccggtagctccgcgctacactcctgcgccagcatcaggcagtcgtccggctgccccctggccgaatgcgcagccaggctaccagaaacagcaaggtgaagtgtatcgccagcttttgcaaacgcccgcgccgatgcaaaaattaaaagcgccggaaccgcaggaacctgcacttgcggcgaacagtcagagttttggtcgggtactgactatcgtccattccgactgtgcgttgctggagcgcgacggcaacatttcacttttatccttgccagtggcagaacgttggctgcgtcaggcacaattgacgccgggtgaagcgcccgtttgcgcccagccgctgctgattccgttgcggctaaaagtttctgccgaagaaaaatcggcattagaaaaagcgcagtctgccctggcggaattgggtattgatttccagtcagatgcacagcatgtgaccatcagggcagtgcctttacccttacgccaacaaaatttacaaatcttgattcctgaactgataggctacctggcgaagcagtccgtattcgaacctggcaatattgcgcagtggattgcacgaaatctgatgagcgaacatgcgcagtggtcaatggcacaggccataaccctgctggcggacgtggaacggttatgtccgcaacttgtgaaaacgccgccgggtggtctgttacaatctgttgatttacatccggcgataaaagccctgaaagatgagtgaacttaattaacggcactcctcagccaagtcaaaagcctccgaccggaggcttttgactacatgcccatggcgtttacgccccgccctgccactcatcgcagtactgttgtaattcattaagcattctgccgacatggaagccatcacaaacggcatgatgaacctgaatcgccagcggcatcagcaccttgtcgccttgcgtataatatttgcccatagtgaaaacgggggcgaagaagttgtccatattggccacgtttaaatcaaaactggtgaaactcacccagggattggctgagacgaaaaacatattctcaataaaccctttagggaaataggccaggttttcaccgtaacacgccacatcttgcgaatatatgtgtagaaactgccggaaatcgtcgtggtattcactccagagcgatgaaaacgtttcagtttgctcatggaaaacggtgtaacaagggtgaacactatcccatatcaccagctcaccgtctttcattgccatacggaactccggatgagcattcatcaggcgggcaagaatgtgaataaaggccggataaaacttgtgcttatttttctttacggtctttaaaaaggccgtaatatccagctgaacggtctggttataggtacattgagcaactgactgaaatgcctcaaaatgttctttacgatgccattgggatatatcaacggtggtatatccagtgatttttttctccattttagcttccttagctcctgaaaatctcgataactcaaaaaatacgcccggtagtgatcttatttcattatggtgaaagttggaacctcttacgtgccaagccaaataggccgt

SEQ ID NO: 63 - DNA, 5621 bp, Artificial Sequence
  Synthetic Polynucleotide
cactcggtcgctacgctccgggcgtgagactgcggcgggcgctgcggacacatacaaagttacccacagattccgtggataagcaggggactaacatgtgaggcaaaacagcagggccgcgccggtggcgtttttccataggctccgccctcctgccagagttcacataaacagacgcttttccggtgcatctgtgggagccgtgaggctcaaccatgaatctgacagtacgggcgaaacccgacaggacttaaagatccccaccgtttccggcgggtcgctccctcttgcgctctcctgttccgaccctgccgtttaccggatacctgttccgcctttctcccttacgggaagtgtggcgctttctcatagctcacacactggtatctcggctcggtgtaggtcgttcgctccaagctgggctgtaagcaagaactccccgttcagcccgactgctgcgccttatccggtaactgttcacttgagtccaacccggaaaagcacggtaaaacgccactggcagcagccattggtaactgggagttcgcagaggatttgtttagctaaacacgcggttgctcttgaagtgtgcgccaaagtccggctacactggaaggacagatttggttgctgtgctctgcgaaagccagttaccacggttaagcagttccccaactgacttaaccttcgatcaaaccacctccccaggtggttttttcgtttacagggcaaaagattacgcgcagaaaaaaaggatctcaagaagatcctttgatcttttctactgaaccgctctagatttcagtgcaatttatctcttcaaatgtagcacctgaagtcagcccaggaggaagaggacatccggtcaaataaaacgaaaggctcagtcgaaagactgggcctttcgttttagacttagggaccctttatgacaacttgacggctacatcattcactttttcttcacaaccggcacggaactcgctcgggctggccccggtgcattttttaaatacccgcgagaaatagagttgatcgtcaaaaccaacattgcgaccgacggtggcgataggcatccgggtggtgctcaaaagcagcttcgcctggctgatacgttggtcctcgcgccagcttaagacgctaatccctaactgctggcggaaaagatgtgacagacgcgacggcgacaagcaaacatgctgtgcgacgctggcgatatcaaaattgctgtctgccaggtgatcgctgatgtactgacaagcctcgcgtacccgattatccatcggtggatggagcgactcgttaatcgcttccatgcgccgcagtaacaattgctcaagcagatttatcgccagcagctccgaatagcgcccttccccttgcccggcgttaatgatttgcccaaacaggtcgctgaaatgcggctggtgcgcttcatccgggcgaaagaaccccgtattggcaaatattgacggccagttaagccattcatgccagtaggcgcgcggacgaaagtaaacccactggtgataccattcgcgagcctccggatgacgaccgtagtgatgaatctctcctggcgggaacagcaaaatatcacccggtcggcaaacaaattctcgtccctgatttttcaccaccccctgaccgcgaatggtgagattgagaatataacctttcattcccagcggtcggtcgataaaaaaatcgagataaccgttggcctcaatcggcgttaaacccgccaccagatgggcattaaacgagtatcccggcagcaggggatcattttgcgcttcagccatacttttcatactcccaccattcagagaagaaaccaattgtccatattgcatcagacattgccgtcactgcgtcttttactggctcttctcgctaacccaaccggtaaccccgcttattaaaagcattctgtaacaaagcgggaccaaagccatgacaaaaacgcgtaacaaaagtgtctataatcacggcagaaaagtccacattgattatttgcacggcgtcacactttgctatgccatagcatttttatccataagattagcggatcctacctgacgctttttatcgcaactctctactgtttctccatacccgtttttttggacgcgtacaactcaagtctgacataaatgaccgctatgagcactgcaattacacgccagatcgttctcgctaccgcaaccaccggtatgaaccagattggtgcgcactatgaaggccacaagatcattgagattggtgccgttgaagtggtgaaccgtcgcctgacgggcaataacttccatgtttatctcaaacccgatcggctggtggatccggaagcctttggcgtacatggtattgccgatgaatttttgctcgataagcccacgtttgccgaagtagccgatgagttcatggactatattcgcggcgcggagttggtgatccataacgcagcgttcgatatcggctttatggactacgagttttcgttgcttaagcgcgatattccgaagaccaatactttctgtaaggtcaccgatagccttgcggtggcgaggaaaatgtttcccggtaagcgcaacagcctcgatgcgttatgtgctcgctacgaaatagataacagtaaacgaacgctgcacggggcattactcgatgcccagatccttgcggaagtttatctggcgatgaccggtggtcaaacgtcgatggcttttgcgatggaaggagagacacaacagcaacaaggtgaagcaacaattcagcgcattgtacgtcaggcaagtaagttacgcgttgtttttgcgacagatgaagagattgcagctcatgaagcccgtctcgatctggtgcagaagaaaggcggaagttgcctctggcgagcataaatcgcacgctgccaaactaaggacgattgatgccaattcaggtcttaccgccacaactggcgaaccagattgccgcaggtgaggtggtcgagcgacctgcgtcggtagtcaaagaactagtggaaaacagcctcgatgcaggtgcgacgcgtatcgatattgatatcgaacgcggtggggcgaaacttatccgcattcgtgataacggctgcggtatcaaaaaagatgagctggcgctggcgctggctcgtcatgccaccagtaaaatcgcctctctggacgatctcgaagccattatcagcctgggctttcgcggtgaggcgctggcgagtatcagttcggtttcccgcctgacgctcacttcacgcaccgcagaacagcaggaagcctggcaggcctatgccgaagggcgcgatatgaacgtgacggtaaaaccggcggcgcatcctgtggggacgacgctggaggtgctggatctgttctacaacaccccggcgcggcgcaaattcctgcgcaccgagaaaaccgaatttaaccacattgatgagatcatccgccgcattgcgctggcgcgtttcgacgtcacgatcaacctgtcgcataacggtaaaattgtgcgtcagtaccgcgcagtgccggaaggcgggcaaaaagaacggcgcttaggcgcgatttgcggcaccgcttttcttgaacaagcgctggcgattgaatggcaacacggcgatctcacgctacgcggctgggtggccgatccaaatcacaccacgcccgcactggcagaaattcagtattgctacgtgaacggtcgcatgatgcgcgatcgcctgatcaatcacgcgatccgccaggcctgcgaagacaaactgggggccgatcagcaaccggcatttgtgttgtatctggagatcgacccacatcaggtggacgtcaacgtgcaccccgccgcgcacgaagtgcgtttccatcagtcgcgtctggtgcatgattttatctatcagggcgtgctgagcgtgctacaacagcaactggaaacgccgctaccgctggacgatgaaccccaacctgcaccgcgttccattccggaaaaccgcgtggcggcggggcgcaatcactttgcagaaccggcagctcgtgagccggtagctccgcgctacactcctgcgccagcatcaggcagtcgtccggctgccccctggccgaatgcgcagccaggctaccagaaacagcaaggtgaagtgtatcgccagcttttgcaaacgcccgcgccgatgcaaaaattaaaagcgccggaaccgcaggaacctgcacttgcggcgaacagtcagagttttggtcgggtactgactatcgtccattccgactgtgcgttgctggagcgcgacggcaacatttcacttttatccttgccagtggcagaacgttggctgcgtcaggcacaattgacgccgggtgaagcgcccgtttgcgcccagccgctgctgattccgttgcggctaaaagtttctgccgaagaaaaatcggcattagaaaaagcgcagtctgccctggcggaattgggtattgatttccagtcagatgcacagcatgtgaccatcagggcagtgcctttacccttacgccaacaaaatttacaaatcttgattcctgaactgataggctacctggcgaagcagtccgtattcgaacctggcaatattgcgcagtggattgcacgaaatctgatgagcgaacatgcgcagtggtcaatggcacaggccataaccctgctggcggacgtggaacggttatgtccgcaacttgtgaaaacgccgccgggtggtctgttacaatctgttgatttacatccggcgataaaagccctgaaagatgagtgaacttaattaacggcactcctcagccaagtcaaaagcctccgaccggaggcttttgactacatgcccatggcgtttacgccccgccctgccactcatcgcagtactgttgtaattcattaagcattctgccgacatggaagccatcacaaacggcatgatgaacctgaatcgccagcggcatcagcaccttgtcgccttgcgtataatatttgcccatagtgaaaacgggggcgaagaagttgtccatattggccacgtttaaatcaaaactggtgaaactcacccagggattggctgagacgaaaaacatattctcaataaaccctttagggaaataggccaggttttcaccgtaacacgccacatcttgcgaatatatgtgtagaaactgccggaaatcgtcgtggtattcactccagagcgatgaaaacgtttcagtttgctcatggaaaacggtgtaacaagggtgaacactatcccatatcaccagctcaccgtctttcattgccatacggaactccggatgagcattcatcaggcgggcaagaatgtgaataaaggccggataaaacttgtgcttatttttctttacggtctttaaaaaggccgtaatatccagctgaacggtctggttataggtacattgagcaactgactgaaatgcctcaaaatgttctttacgatgccattgggatatatcaacggtggtatatccagtgatttttttctccattttagcttccttagctcctgaaaatctcgataactcaaaaaatacgcccggtagtgatcttatttcattatggtgaaagttggaacctcttacgtgccaagccaaataggccgt

SEQ ID NO: 64 - DNA, 4463 bp, Artificial Sequence
  Synthetic Polynucleotide
cactcggtcgctacgctccgggcgtgagactgcggcgggcgctgcggacacatacaaagttacccacagattccgtggataagcaggggactaacatgtgaggcaaaacagcagggccgcgccggtggcgtttttccataggctccgccctcctgccagagttcacataaacagacgcttttccggtgcatctgtgggagccgtgaggctcaaccatgaatctgacagtacgggcgaaacccgacaggacttaaagatccccaccgtttccggcgggtcgctccctcttgcgctctcctgttccgaccctgccgtttaccggatacctgttccgcctttctcccttacgggaagtgtggcgctttctcatagctcacacactggtatctcggctcggtgtaggtcgttcgctccaagctgggctgtaagcaagaactccccgttcagcccgactgctgcgccttatccggtaactgttcacttgagtccaacccggaaaagcacggtaaaacgccactggcagcagccattggtaactgggagttcgcagaggatttgtttagctaaacacgcggttgctcttgaagtgtgcgccaaagtccggctacactggaaggacagatttggttgctgtgctctgcgaaagccagttaccacggttaagcagttccccaactgacttaaccttcgatcaaaccacctccccaggtggttttttcgtttacagggcaaaagattacgcgcagaaaaaaaggatctcaagaagatcctttgatcttttctactgaaccgctctagatttcagtgcaatttatctcttcaaatgtagcacctgaagtcagcccaggaggaagaggacatccggtcaaataaaacgaaaggctcagtcgaaagactgggcctttcgttttagacttagggaccctttatgacaacttgacggctacatcattcactttttcttcacaaccggcacggaactcgctcgggctggccccggtgcattttttaaatacccgcgagaaatagagttgatcgtcaaaaccaacattgcgaccgacggtggcgataggcatccgggtggtgctcaaaagcagcttcgcctggctgatacgttggtcctcgcgccagcttaagacgctaatccctaactgctggcggaaaagatgtgacagacgcgacggcgacaagcaaacatgctgtgcgacgctggcgatatcaaaattgctgtctgccaggtgatcgctgatgtactgacaagcctcgcgtacccgattatccatcggtggatggagcgactcgttaatcgcttccatgcgccgcagtaacaattgctcaagcagatttatcgccagcagctccgaatagcgcccttccccttgcccggcgttaatgatttgcccaaacaggtcgctgaaatgcggctggtgcgcttcatccgggcgaaagaaccccgtattggcaaatattgacggccagttaagccattcatgccagtaggcgcgcggacgaaagtaaacccactggtgataccattcgcgagcctccggatgacgaccgtagtgatgaatctctcctggcgggaacagcaaaatatcacccggtcggcaaacaaattctcgtccctgatttttcaccaccccctgaccgcgaatggtgagattgagaatataacctttcattcccagcggtcggtcgataaaaaaatcgagataaccgttggcctcaatcggcgttaaacccgccaccagatgggcattaaacgagtatcccggcagcaggggatcattttgcgcttcagccatacttttcatactcccaccattcagagaagaaaccaattgtccatattgcatcagacattgccgtcactgcgtcttttactggctcttctcgctaacccaaccggtaaccccgcttattaaaagcattctgtaacaaagcgggaccaaagccatgacaaaaacgcgtaacaaaagtgtctataatcacggcagaaaagtccacattgattatttgcacggcgtcacactttgctatgccatagcatttttatccataagattagcggatcctacctgacgctttttatcgcaactctctactgtttctccatacccgtttttttggacgcgtacaactcaagtctgacataaatgaccgctatgagcactgcaattacacgccagatcgttctcgctaccgcaaccaccggtatgaaccagattggtgcgcactatgaaggccacaagatcattgagattggtgccgttgaagtggtgaaccgtcgcctgacgggcaataacttccatgtttatctcaaacccgatcggctggtggatccggaagcctttggcgtacatggtattgccgatgaatttttgctcgataagcccacgtttgccgaagtagccgatgagttcatggactatattcgcggcgcggagttggtgatccataacgcagcgttcgatatcggctttatggactacgagttttcgttgcttaagcgcgatattccgaagaccaatactttctgtaaggtcaccgatagccttgcggtggcgaggaaaatgtttcccggtaagcgcaacagcctcgatgcgttatgtgctcgctacgaaatagataacagtaaacgaacgctgcacggggcattactcgatgcccagatccttgcggaagtttatctggcgatgaccggtggtcaaacgtcgatggcttttgcgatggaaggagagacacaacagcaacaaggtgaagcaacaattcagcgcattgtacgtcaggcaagtaagttacgcgttgtttttgcgacagatgaagagattgcagctcatgaagcccgtctcgatctggtgcagaagaaaggcggaagttgcctctggcgagcataatgtttgttttttaatcaaggtatcatgacatgtcccaacctcgcccactgctctctcctcccgaaactgaagaacagttgttagcgcaagcacagcaactttctggttatacattgggagaactggcggcacttgtcgggctggttacgccagagaatttaaaacgcgataaaggctggattggcgtgttactggcgatctggctaggtgccagcgcagggagtaaacctgagcaagattttgctgctctgggcgtggaacttaaaactatccctgtggatagtcttggtcgtccgctggaaacaacattcgtttgtgttgccccgttaacgggcaatagcggggtgacctgggaaaccagccacgtgcgccacaaactcaaacgcgtactgtggataccggttgaaggcgagcgcagcatcccgctggcgcagcgtcgcgttggatcaccgttgctgtggagcccgaatgaagaggaagaccggcagctacgcgaagactgggaagaattaatggatatgattgttctcggtcaggttgagcggattaccgctcgtcacggggagtatttacagatacgaccgaaagcagcgaatgcgaaagcgcttaccgaagccattggtgcccggggcgaacggattctgacgctgccacgcggcttttatttgaagaagaatttcaccagtgcactactggcccgtcattttctgatccagtagacttaattaacggcactcctcagccaagtcaaaagcctccgaccggaggcttttgactacatgcccatggcgtttacgccccgccctgccactcatcgcagtactgttgtaattcattaagcattctgccgacatggaagccatcacaaacggcatgatgaacctgaatcgccagcggcatcagcaccttgtcgccttgcgtataatatttgcccatagtgaaaacgggggcgaagaagttgtccatattggccacgtttaaatcaaaactggtgaaactcacccagggattggctgagacgaaaaacatattctcaataaaccctttagggaaataggccaggttttcaccgtaacacgccacatcttgcgaatatatgtgtagaaactgccggaaatcgtcgtggtattcactccagagcgatgaaaacgtttcagtttgctcatggaaaacggtgtaacaagggtgaacactatcccatatcaccagctcaccgtctttcattgccatacggaactccggatgagcattcatcaggcgggcaagaatgtgaataaaggccggataaaacttgtgcttatttttctttacggtctttaaaaaggccgtaatatccagctgaacggtctggttataggtacattgagcaactgactgaaatgcctcaaaatgttctttacgatgccattgggatatatcaacggtggtatatccagtgatttttttctccattttagcttccttagctcctgaaaatctcgataactcaaaaaatacgcccggtagtgatcttatttcattatggtgaaagttggaacctcttacgtgccaagccaaataggccgt

SEQ ID NO: 65 - DNA, 4463 bp, Artificial Sequence
  Synthetic Polynucleotide
cactcggtcgctacgctccgggcgtgagactgcggcgggcgctgcggacacatacaaagttacccacagattccgtggataagcaggggactaacatgtgaggcaaaacagcagggccgcgccggtggcgtttttccataggctccgccctcctgccagagttcacataaacagacgcttttccggtgcatctgtgggagccgtgaggctcaaccatgaatctgacagtacgggcgaaacccgacaggacttaaagatccccaccgtttccggcgggtcgctccctcttgcgctctcctgttccgaccctgccgtttaccggatacctgttccgcctttctcccttacgggaagtgtggcgctttctcatagctcacacactggtatctcggctcggtgtaggtcgttcgctccaagctgggctgtaagcaagaactccccgttcagcccgactgctgcgccttatccggtaactgttcacttgagtccaacccggaaaagcacggtaaaacgccactggcagcagccattggtaactgggagttcgcagaggatttgtttagctaaacacgcggttgctcttgaagtgtgcgccaaagtccggctacactggaaggacagatttggttgctgtgctctgcgaaagccagttaccacggttaagcagttccccaactgacttaaccttcgatcaaaccacctccccaggtggttttttcgtttacagggcaaaagattacgcgcagaaaaaaaggatctcaagaagatcctttgatcttttctactgaaccgctctagatttcagtgcaatttatctcttcaaatgtagcacctgaagtcagcccaggaggaagaggacatccggtcaaataaaacgaaaggctcagtcgaaagactgggcctttcgttttagacttagggaccctttatgacaacttgacggctacatcattcactttttcttcacaaccggcacggaactcgctcgggctggccccggtgcattttttaaatacccgcgagaaatagagttgatcgtcaaaaccaacattgcgaccgacggtggcgataggcatccgggtggtgctcaaaagcagcttcgcctggctgatacgttggtcctcgcgccagcttaagacgctaatccctaactgctggcggaaaagatgtgacagacgcgacggcgacaagcaaacatgctgtgcgacgctggcgatatcaaaattgctgtctgccaggtgatcgctgatgtactgacaagcctcgcgtacccgattatccatcggtggatggagcgactcgttaatcgcttccatgcgccgcagtaacaattgctcaagcagatttatcgccagcagctccgaatagcgcccttccccttgcccggcgttaatgatttgcccaaacaggtcgctgaaatgcggctggtgcgcttcatccgggcgaaagaaccccgtattggcaaatattgacggccagttaagccattcatgccagtaggcgcgcggacgaaagtaaacccactggtgataccattcgcgagcctccggatgacgaccgtagtgatgaatctctcctggcgggaacagcaaaatatcacccggtcggcaaacaaattctcgtccctgatttttcaccaccccctgaccgcgaatggtgagattgagaatataacctttcattcccagcggtcggtcgataaaaaaatcgagataaccgttggcctcaatcggcgttaaacccgccaccagatgggcattaaacgagtatcccggcagcaggggatcattttgcgcttcagccatacttttcatactcccaccattcagagaagaaaccaattgtccatattgcatcagacattgccgtcactgcgtcttttactggctcttctcgctaacccaaccggtaaccccgcttattaaaagcattctgtaacaaagcgggaccaaagccatgacaaaaacgcgtaacaaaagtgtctataatcacggcagaaaagtccacattgattatttgcacggcgtcacactttgctatgccatagcatttttatccataagattagcggatcctacctgacgctttttatcgcaactctctactgtttctccatacccgtttttttggacgcgtacaactcaagtctgacataaatgaccgctatgagcactgcaattacacgccagatcgttctcgctaccgcaaccaccggtatgaaccagattggtgcgcactatgaaggccacaagatcattgagattggtgccgttgaagtggtgaaccgtcgcctgacgggcaataacttccatgtttatctcaaacccgatcggctggtggatccggaagcctttggcgtacatggtattgccgatgaatttttgctcgataagcccacgtttgccgaagtagccgatgagttcatggactatattcgcggcgcggagttggtgatccataacgcagcgttcgatatcggctttatggactacgagttttcgttgcttaagcgcgatattccgaagaccaatactttctgtaaggtcaccgatagccttgcggtggcgaggaaaatgtttcccggtaagcgcaacagcctcgatgcgttatgtgctcgctacgaaatagataacagtaaacgaacgctgcacggggcattactcgatgcccagatccttgcggaagtttatctggcgatgaccggtggtcaaacgtcgatggcttttgcgatggaaggagagacacaacagcaacaaggtgaagcaacaattcagcgcattgtacgtcaggcaagtaagttacgcgttgtttttgcgacagatgaagagattgcagctcatgaagcccgtctcgatctggtgcagaagaaaggcggaagttgcctctggcgagcataatgtttgttttttaatcaaggtatcatgacatgtcccaacctcgcccactgctctctcctcccgaaactgaagaacagttgttagcgcaagcacagcaactttctggttatacattgggagaactggcggcacttgtcgggctggttacgccagagaatttaaaacgcgataaaggctggattggcgtgttactggagatctggctaggtgccagcgcagggagtaaacctgagcaagattttgctgctctgggcgtggaacttgaaactatccctgtggatagtcttggtcgtccgctggaaacaacattcgtttgtgttgccccgttaacgggcaatagcggggtgacctgggaaaccagccacgtgcgccacaaactcaaacgcgtactgtggataccggttgaaggcgagcgcagcatcccgctggcgcagcgtcgcgttggatcaccgttgctgtggagcccgaatgaagaggaagaccggcagctacgcgaagactgggaagaattaatggatatgattgttctcggtcaggttgagcggattaccgctcgtcacggggagtatttacagatacgaccgaaagcagcgaatgcgaaagcgcttaccgaagccattggtgcccggggcgaacggattctgacgctgccacgcggcttttatttgaagaagaatttcaccagtgcactactggcccgtcattttctgatccagtagacttaattaacggcactcctcagccaagtcaaaagcctccgaccggaggcttttgactacatgcccatggcgtttacgccccgccctgccactcatcgcagtactgttgtaattcattaagcattctgccgacatggaagccatcacaaacggcatgatgaacctgaatcgccagcggcatcagcaccttgtcgccttgcgtataatatttgcccatagtgaaaacgggggcgaagaagttgtccatattggccacgtttaaatcaaaactggtgaaactcacccagggattggctgagacgaaaaacatattctcaataaaccctttagggaaataggccaggttttcaccgtaacacgccacatcttgcgaatatatgtgtagaaactgccggaaatcgtcgtggtattcactccagagcgatgaaaacgtttcagtttgctcatggaaaacggtgtaacaagggtgaacactatcccatatcaccagctcaccgtctttcattgccatacggaactccggatgagcattcatcaggcgggcaagaatgtgaataaaggccggataaaacttgtgcttatttttctttacggtctttaaaaaggccgtaatatccagctgaacggtctggttataggtacattgagcaactgactgaaatgcctcaaaatgttctttacgatgccattgggatatatcaacggtggtatatccagtgatttttttctccattttagcttccttagctcctgaaaatctcgataactcaaaaaatacgcccggtagtgatcttatttcattatggtgaaagttggaacctcttacgtgccaagccaaataggccgt

SEQ ID NO: 66 - DNA, 4463 bp, Artificial Sequence
  Synthetic Polynucleotide
cactcggtcgctacgctccgggcgtgagactgcggcgggcgctgcggacacatacaaagttacccacagattccgtggataagcaggggactaacatgtgaggcaaaacagcagggccgcgccggtggcgtttttccataggctccgccctcctgccagagttcacataaacagacgcttttccggtgcatctgtgggagccgtgaggctcaaccatgaatctgacagtacgggcgaaacccgacaggacttaaagatccccaccgtttccggcgggtcgctccctcttgcgctctcctgttccgaccctgccgtttaccggatacctgttccgcctttctcccttacgggaagtgtggcgctttctcatagctcacacactggtatctcggctcggtgtaggtcgttcgctccaagctgggctgtaagcaagaactccccgttcagcccgactgctgcgccttatccggtaactgttcacttgagtccaacccggaaaagcacggtaaaacgccactggcagcagccattggtaactgggagttcgcagaggatttgtttagctaaacacgcggttgctcttgaagtgtgcgccaaagtccggctacactggaaggacagatttggttgctgtgctctgcgaaagccagttaccacggttaagcagttccccaactgacttaaccttcgatcaaaccacctccccaggtggttttttcgtttacagggcaaaagattacgcgcagaaaaaaaggatctcaagaagatcctttgatcttttctactgaaccgctctagatttcagtgcaatttatctcttcaaatgtagcacctgaagtcagcccaggaggaagaggacatccggtcaaataaaacgaaaggctcagtcgaaagactgggcctttcgttttagacttagggaccctttatgacaacttgacggctacatcattcactttttcttcacaaccggcacggaactcgctcgggctggccccggtgcattttttaaatacccgcgagaaatagagttgatcgtcaaaaccaacattgcgaccgacggtggcgataggcatccgggtggtgctcaaaagcagcttcgcctggctgatacgttggtcctcgcgccagcttaagacgctaatccctaactgctggcggaaaagatgtgacagacgcgacggcgacaagcaaacatgctgtgcgacgctggcgatatcaaaattgctgtctgccaggtgatcgctgatgtactgacaagcctcgcgtacccgattatccatcggtggatggagcgactcgttaatcgcttccatgcgccgcagtaacaattgctcaagcagatttatcgccagcagctccgaatagcgcccttccccttgcccggcgttaatgatttgcccaaacaggtcgctgaaatgcggctggtgcgcttcatccgggcgaaagaaccccgtattggcaaatattgacggccagttaagccattcatgccagtaggcgcgcggacgaaagtaaacccactggtgataccattcgcgagcctccggatgacgaccgtagtgatgaatctctcctggcgggaacagcaaaatatcacccggtcggcaaacaaattctcgtccctgatttttcaccaccccctgaccgcgaatggtgagattgagaatataacctttcattcccagcggtcggtcgataaaaaaatcgagataaccgttggcctcaatcggcgttaaacccgccaccagatgggcattaaacgagtatcccggcagcaggggatcattttgcgcttcagccatacttttcatactcccaccattcagagaagaaaccaattgtccatattgcatcagacattgccgtcactgcgtcttttactggctcttctcgctaacccaaccggtaaccccgcttattaaaagcattctgtaacaaagcgggaccaaagccatgacaaaaacgcgtaacaaaagtgtctataatcacggcagaaaagtccacattgattatttgcacggcgtcacactttgctatgccatagcatttttatccataagattagcggatcctacctgacgctttttatcgcaactctctactgtttctccatacccgtttttttggacgcgtacaactcaagtctgacataaatgaccgctatgagcactgcaattacacgccagatcgttctcgctaccgcaaccaccggtatgaaccagattggtgcgcactatgaaggccacaagatcattgagattggtgccgttgaagtggtgaaccgtcgcctgacgggcaataacttccatgtttatctcaaacccgatcggctggtggatccggaagcctttggcgtacatggtattgccgatgaatttttgctcgataagcccacgtttgccgaagtagccgatgagttcatggactatattcgcggcgcggagttggtgatccataacgcagcgttcgatatcggctttatggactacgagttttcgttgcttaagcgcgatattccgaagaccaatactttctgtaaggtcaccgatagccttgcggtggcgaggaaaatgtttcccggtaagcgcaacagcctcgatgcgttatgtgctcgctacgaaatagataacagtaaacgaacgctgcacggggcattactcgatgcccagatccttgcggaagtttatctggcgatgaccggtggtcaaacgtcgatggcttttgcgatggaaggagagacacaacagcaacaaggtgaagcaacaattcagcgcattgtacgtcaggcaagtaagttacgcgttgtttttgcgacagatgaagagattgcagctcatgaagcccgtctcgatctggtgcagaagaaaggcggaagttgcctctggcgagcataatgtttgttttttaatcaaggtatcatgacatgtcccaacctcgcccactgctctctcctcccgaaactgaagaacagttgttagcgcaagcacagcaactttctggttatacattgggagaactggcggcacttgtcgggctggttacgccagagaatttaaaacgcgataaaggctggattggcgtgttactggagatctggctaggtgccagcgcagggagtaaacctgagcaagattttgctgctctgggcgtggaacttaaaactatccctgtggatagtcttggtcgtccgctggaaacaacattcgtttgtgttgccccgttaacgggcaatagcggggtgacctgggaaaccagccacgtgcgccacgaactcaaacgcgtactgtggataccggttgaaggcgagcgcagcatcccgctggcgcagcgtcgcgttggatcaccgttgctgtggagcccgaatgaagaggaagaccggcagctacgcgaagactgggaagaattaatggatatgattgttctcggtcaggttgagcggattaccgctcgtcacggggagtatttacagatacgaccgaaagcagcgaatgcgaaagcgcttaccgaagccattggtgcccggggcgaacggattctgacgctgccacgcggcttttatttgaagaagaatttcaccagtgcactactggcccgtcattttctgatccagtagacttaattaacggcactcctcagccaagtcaaaagcctccgaccggaggcttttgactacatgcccatggcgtttacgccccgccctgccactcatcgcagtactgttgtaattcattaagcattctgccgacatggaagccatcacaaacggcatgatgaacctgaatcgccagcggcatcagcaccttgtcgccttgcgtataatatttgcccatagtgaaaacgggggcgaagaagttgtccatattggccacgtttaaatcaaaactggtgaaactcacccagggattggctgagacgaaaaacatattctcaataaaccctttagggaaataggccaggttttcaccgtaacacgccacatcttgcgaatatatgtgtagaaactgccggaaatcgtcgtggtattcactccagagcgatgaaaacgtttcagtttgctcatggaaaacggtgtaacaagggtgaacactatcccatatcaccagctcaccgtctttcattgccatacggaactccggatgagcattcatcaggcgggcaagaatgtgaataaaggccggataaaacttgtgcttatttttctttacggtctttaaaaaggccgtaatatccagctgaacggtctggttataggtacattgagcaactgactgaaatgcctcaaaatgttctttacgatgccattgggatatatcaacggtggtatatccagtgatttttttctccattttagcttccttagctcctgaaaatctcgataactcaaaaaatacgcccggtagtgatcttatttcattatggtgaaagttggaacctcttacgtgccaagccaaataggccgt

SEQ ID NO: 67 - DNA, 3552 bp, Artificial Sequence
  Synthetic Polynucleotide
cactcggtcgctacgctccgggcgtgagactgcggcgggcgctgcggacacatacaaagttacccacagattccgtggataagcaggggactaacatgtgaggcaaaacagcagggccgcgccggtggcgtttttccataggctccgccctcctgccagagttcacataaacagacgcttttccggtgcatctgtgggagccgtgaggctcaaccatgaatctgacagtacgggcgaaacccgacaggacttaaagatccccaccgtttccggcgggtcgctccctcttgcgctctcctgttccgaccctgccgtttaccggatacctgttccgcctttctcccttacgggaagtgtggcgctttctcatagctcacacactggtatctcggctcggtgtaggtcgttcgctccaagctgggctgtaagcaagaactccccgttcagcccgactgctgcgccttatccggtaactgttcacttgagtccaacccggaaaagcacggtaaaacgccactggcagcagccattggtaactgggagttcgcagaggatttgtttagctaaacacgcggttgctcttgaagtgtgcgccaaagtccggctacactggaaggacagatttggttgctgtgctctgcgaaagccagttaccacggttaagcagttccccaactgacttaaccttcgatcaaaccacctccccaggtggttttttcgtttacagggcaaaagattacgcgcagaaaaaaaggatctcaagaagatcctttgatcttttctactgaaccgctctagatttcagtgcaatttatctcttcaaatgtagcacctgaagtcagcccaggaggaagaggacatccggtcaaataaaacgaaaggctcagtcgaaagactgggcctttcgttttagacttagggaccctttatgacaacttgacggctacatcattcactttttcttcacaaccggcacggaactcgctcgggctggccccggtgcattttttaaatacccgcgagaaatagagttgatcgtcaaaaccaacattgcgaccgacggtggcgataggcatccgggtggtgctcaaaagcagcttcgcctggctgatacgttggtcctcgcgccagcttaagacgctaatccctaactgctggcggaaaagatgtgacagacgcgacggcgacaagcaaacatgctgtgcgacgctggcgatatcaaaattgctgtctgccaggtgatcgctgatgtactgacaagcctcgcgtacccgattatccatcggtggatggagcgactcgttaatcgcttccatgcgccgcagtaacaattgctcaagcagatttatcgccagcagctccgaatagcgcccttccccttgcccggcgttaatgatttgcccaaacaggtcgctgaaatgcggctggtgcgcttcatccgggcgaaagaaccccgtattggcaaatattgacggccagttaagccattcatgccagtaggcgcgcggacgaaagtaaacccactggtgataccattcgcgagcctccggatgacgaccgtagtgatgaatctctcctggcgggaacagcaaaatatcacccggtcggcaaacaaattctcgtccctgatttttcaccaccccctgaccgcgaatggtgagattgagaatataacctttcattcccagcggtcggtcgataaaaaaatcgagataaccgttggcctcaatcggcgttaaacccgccaccagatgggcattaaacgagtatcccggcagcaggggatcattttgcgcttcagccatacttttcatactcccaccattcagagaagaaaccaattgtccatattgcatcagacattgccgtcactgcgtcttttactggctcttctcgctaacccaaccggtaaccccgcttattaaaagcattctgtaacaaagcgggaccaaagccatgacaaaaacgcgtaacaaaagtgtctataatcacggcagaaaagtccacattgattatttgcacggcgtcacactttgctatgccatagcatttttatccataagattagcggatcctacctgacgctttttatcgcaactctctactgtttctccatacccgtttttttggacgcgtacaactcaagtctgacataaatgaccgctatggcaagatatttgggtcctaagctcaagctgagccgtcgtgagggcaccgacttattccttaagtctggcgttcgcgcgatcgataccaagtgtaaaattgaacaagctcctggccagcacggtgcgcgtaaaccgcgtctgtctgactatggtgtgcagttgcgtgaaaagcaaaaagttcgccgtatctatggtgtgctggagcgtcagttccgtaactactacaaagaagcagcacgtctgaaaggcaacaccggtgaaaacctgttggctctgctggaaggtcgtctggacaacgttgtataccgtatgggcttcggtgccactcgtgcagaagcacgtcagctggttagccataaagcaattatggtaaacggtcgtgttgttaacatcgcttcttatcaggttagtccgaatgacgttgtaagcattcgtgagaaagcgaagaagcagtctcgcgtgaaagccgctctggagctggctgagcagcgtgaaaagccaacctggctggaagttgatgctggaaggtacgtttaaacttaattaacggcactcctcagccaagtcaaaagcctccgaccggaggcttttgactacatgcccatggcgtttacgccccgccctgccactcatcgcagtactgttgtaattcattaagcattctgccgacatggaagccatcacaaacggcatgatgaacctgaatcgccagcggcatcagcaccttgtcgccttgcgtataatatttgcccatagtgaaaacgggggcgaagaagttgtccatattggccacgtttaaatcaaaactggtgaaactcacccagggattggctgagacgaaaaacatattctcaataaaccctttagggaaataggccaggttttcaccgtaacacgccacatcttgcgaatatatgtgtagaaactgccggaaatcgtcgtggtattcactccagagcgatgaaaacgtttcagtttgctcatggaaaacggtgtaacaagggtgaacactatcccatatcaccagctcaccgtctttcattgccatacggaactccggatgagcattcatcaggcgggcaagaatgtgaataaaggccggataaaacttgtgcttatttttctttacggtctttaaaaaggccgtaatatccagctgaacggtctggttataggtacattgagcaactgactgaaatgcctcaaaatgttctttacgatgccattgggatatatcaacggtggtatatccagtgatttttttctccattttagcttccttagctcctgaaaatctcgataactcaaaaaatacgcccggtagtgatcttatttcattatggtgaaagttggaacctcttacgtgccaagccaaataggccgt

SEQ ID NO: 68 - DNA, 3561 bp, Artificial Sequence
  Synthetic Polynucleotide
cactcggtcgctacgctccgggcgtgagactgcggcgggcgctgcggacacatacaaagttacccacagattccgtggataagcaggggactaacatgtgaggcaaaacagcagggccgcgccggtggcgtttttccataggctccgccctcctgccagagttcacataaacagacgcttttccggtgcatctgtgggagccgtgaggctcaaccatgaatctgacagtacgggcgaaacccgacaggacttaaagatccccaccgtttccggcgggtcgctccctcttgcgctctcctgttccgaccctgccgtttaccggatacctgttccgcctttctcccttacgggaagtgtggcgctttctcatagctcacacactggtatctcggctcggtgtaggtcgttcgctccaagctgggctgtaagcaagaactccccgttcagcccgactgctgcgccttatccggtaactgttcacttgagtccaacccggaaaagcacggtaaaacgccactggcagcagccattggtaactgggagttcgcagaggatttgtttagctaaacacgcggttgctcttgaagtgtgcgccaaagtccggctacactggaaggacagatttggttgctgtgctctgcgaaagccagttaccacggttaagcagttccccaactgacttaaccttcgatcaaaccacctccccaggtggttttttcgtttacagggcaaaagattacgcgcagaaaaaaaggatctcaagaagatcctttgatcttttctactgaaccgctctagatttcagtgcaatttatctcttcaaatgtagcacctgaagtcagcccaggaggaagaggacatccggtcaaataaaacgaaaggctcagtcgaaagactgggcctttcgttttagacttagggaccctttatgacaacttgacggctacatcattcactttttcttcacaaccggcacggaactcgctcgggctggccccggtgcattttttaaatacccgcgagaaatagagttgatcgtcaaaaccaacattgcgaccgacggtggcgataggcatccgggtggtgctcaaaagcagcttcgcctggctgatacgttggtcctcgcgccagcttaagacgctaatccctaactgctggcggaaaagatgtgacagacgcgacggcgacaagcaaacatgctgtgcgacgctggcgatatcaaaattgctgtctgccaggtgatcgctgatgtactgacaagcctcgcgtacccgattatccatcggtggatggagcgactcgttaatcgcttccatgcgccgcagtaacaattgctcaagcagatttatcgccagcagctccgaatagcgcccttccccttgcccggcgttaatgatttgcccaaacaggtcgctgaaatgcggctggtgcgcttcatccgggcgaaagaaccccgtattggcaaatattgacggccagttaagccattcatgccagtaggcgcgcggacgaaagtaaacccactggtgataccattcgcgagcctccggatgacgaccgtagtgatgaatctctcctggcgggaacagcaaaatatcacccggtcggcaaacaaattctcgtccctgatttttcaccaccccctgaccgcgaatggtgagattgagaatataacctttcattcccagcggtcggtcgataaaaaaatcgagataaccgttggcctcaatcggcgttaaacccgccaccagatgggcattaaacgagtatcccggcagcaggggatcattttgcgcttcagccatacttttcatactcccaccattcagagaagaaaccaattgtccatattgcatcagacattgccgtcactgcgtcttttactggctcttctcgctaacccaaccggtaaccccgcttattaaaagcattctgtaacaaagcgggaccaaagccatgacaaaaacgcgtaacaaaagtgtctataatcacggcagaaaagtccacattgattatttgcacggcgtcacactttgctatgccatagcatttttatccataagattagcggatcctacctgacgctttttatcgcaactctctactgtttctccatacccgtttttttggacgcgtacaactcaagtctgacataaatgaccgctatggcaagatatttgggtcctaagctcaagctgagccgtcgtgagggcaccgacttattccttaagtctggcgttcgcgcgatcgataccaagtgtaaaattgaacaagctcctggccagcacggtgcgcgtaaaccgcgtctgtctgactatggtgtgcagttgcgtgaaaagcaaaaagttcgccgtatctatggtgtgctggagcgtcagttccgtaactactacaaagaagcagcacgtctgaaaggcaacaccggtgaaaacctgttggctctgctggaaggtcgtctggacaacgttgtataccgtatgggcttcggtgccactcgtgcagaagcacgtcagctggttagccataaagcaattatggtaaacggtcgtgttgttaacatcgcttcttatcaggttagtccgaatgacgttgtaagcattcgtgagaaagcgaagaagcagtctcgcgtgaaagccgctctggagctggctgagcagcgtgaaaagccaacctggctggaagttgatgctggcaagatggcaaggtacgtttaaacttaattaacggcactcctcagccaagtcaaaagcctccgaccggaggcttttgactacatgcccatggcgtttacgccccgccctgccactcatcgcagtactgttgtaattcattaagcattctgccgacatggaagccatcacaaacggcatgatgaacctgaatcgccagcggcatcagcaccttgtcgccttgcgtataatatttgcccatagtgaaaacgggggcgaagaagttgtccatattggccacgtttaaatcaaaactggtgaaactcacccagggattggctgagacgaaaaacatattctcaataaaccctttagggaaataggccaggttttcaccgtaacacgccacatcttgcgaatatatgtgtagaaactgccggaaatcgtcgtggtattcactccagagcgatgaaaacgtttcagtttgctcatggaaaacggtgtaacaagggtgaacactatcccatatcaccagctcaccgtctttcattgccatacggaactccggatgagcattcatcaggcgggcaagaatgtgaataaaggccggataaaacttgtgcttatttttctttacggtctttaaaaaggccgtaatatccagctgaacggtctggttataggtacattgagtaactgactgaaatgcctcaaaatgttctttacgatgccattgggatatatcaacggtggtatatccagtgatttttttctccattttagcttccttagctcctgaaaatctcgataactcaaaaaatacgcccggtagtgatcttatttcattatggtgaaagttggaacctcttacgtgccaagccaaataggccgt

SEQ ID NO: 69 - DNA, 3522 bp, Artificial Sequence
  Synthetic Polynucleotide
cactcggtcgctacgctccgggcgtgagactgcggcgggcgctgcggacacatacaaagttacccacagattccgtggataagcaggggactaacatgtgaggcaaaacagcagggccgcgccggtggcgtttttccataggctccgccctcctgccagagttcacataaacagacgcttttccggtgcatctgtgggagccgtgaggctcaaccatgaatctgacagtacgggcgaaacccgacaggacttaaagatccccaccgtttccggcgggtcgctccctcttgcgctctcctgttccgaccctgccgtttaccggatacctgttccgcctttctcccttacgggaagtgtggcgctttctcatagctcacacactggtatctcggctcggtgtaggtcgttcgctccaagctgggctgtaagcaagaactccccgttcagcccgactgctgcgccttatccggtaactgttcacttgagtccaacccggaaaagcacggtaaaacgccactggcagcagccattggtaactgggagttcgcagaggatttgtttagctaaacacgcggttgctcttgaagtgtgcgccaaagtccggctacactggaaggacagatttggttgctgtgctctgcgaaagccagttaccacggttaagcagttccccaactgacttaaccttcgatcaaaccacctccccaggtggttttttcgtttacagggcaaaagattacgcgcagaaaaaaaggatctcaagaagatcctttgatcttttctactgaaccgctctagatttcagtgcaatttatctcttcaaatgtagcacctgaagtcagcccaggaggaagaggacatccggtcaaataaaacgaaaggctcagtcgaaagactgggcctttcgttttagacttagggaccctttatgacaacttgacggctacatcattcactttttcttcacaaccggcacggaactcgctcgggctggccccggtgcattttttaaatacccgcgagaaatagagttgatcgtcaaaaccaacattgcgaccgacggtggcgataggcatccgggtggtgctcaaaagcagcttcgcctggctgatacgttggtcctcgcgccagcttaagacgctaatccctaactgctggcggaaaagatgtgacagacgcgacggcgacaagcaaacatgctgtgcgacgctggcgatatcaaaattgctgtctgccaggtgatcgctgatgtactgacaagcctcgcgtacccgattatccatcggtggatggagcgactcgttaatcgcttccatgcgccgcagtaacaattgctcaagcagatttatcgccagcagctccgaatagcgcccttccccttgcccggcgttaatgatttgcccaaacaggtcgctgaaatgcggctggtgcgcttcatccgggcgaaagaaccccgtattggcaaatattgacggccagttaagccattcatgccagtaggcgcgcggacgaaagtaaacccactggtgataccattcgcgagcctccggatgacgaccgtagtgatgaatctctcctggcgggaacagcaaaatatcacccggtcggcaaacaaattctcgtccctgatttttcaccaccccctgaccgcgaatggtgagattgagaatataacctttcattcccagcggtcggtcgataaaaaaatcgagataaccgttggcctcaatcggcgttaaacccgccaccagatgggcattaaacgagtatcccggcagcaggggatcattttgcgcttcagccatacttttcatactcccaccattcagagaagaaaccaattgtccatattgcatcagacattgccgtcactgcgtcttttactggctcttctcgctaacccaaccggtaaccccgcttattaaaagcattctgtaacaaagcgggaccaaagccatgacaaaaacgcgtaacaaaagtgtctataatcacggcagaaaagtccacattgattatttgcacggcgtcacactttgctatgccatagcatttttatccataagattagcggatcctacctgacgctttttatcgcaactctctactgtttctccatacccgtttttttggacgcgtacaactcaagtctgacataaatgaccgctatggcaagatatttgggtcctaagctcaagctgagccgtcgtgagggcaccgacttattccttaagtctggcgttcgcgcgatcgataccaagtgtaaaattgaacaagctcctggccagcacggtgcgcgtaaaccgcgtctgtctgactatggtgtgcagttgcgtgaaaagcaaaaagttcgccgtatctatggtgtgctggagcgtcagttccgtaactactacaaagaagcagcacgtctgaaaggcaacaccggtgaaaacctgttggctctgctggaaggtcgtctggacaacgttgtataccgtatgggcttcggtgccactcgtgcagaagcacgtcagctggttagccataaagcaattatggtaaacggtcgtgttgttaacatcgcttcttatcaggttagtccgaatgacgttgtaagcattcgtgagaaagcgaagaagcagtctcgcgtgaaagccgctctggagctggctgagcagcgtgaaaagccaacctaaacttaattaacggcactcctcagccaagtcaaaagcctccgaccggaggcttttgactacatgcccatggcgtttacgccccgccctgccactcatcgcagtactgttgtaattcattaagcattctgccgacatggaagccatcacaaacggcatgatgaacctgaatcgccagcggcatcagcaccttgtcgccttgcgtataatatttgcccatagtgaaaacgggggcgaagaagttgtccatattggccacgtttaaatcaaaactggtgaaactcacccagggattggctgagacgaaaaacatattctcaataaaccctttagggaaataggccaggttttcaccgtaacacgccacatcttgcgaatatatgtgtagaaactgccggaaatcgtcgtggtattcactccagagcgatgaaaacgtttcagtttgctcatggaaaacggtgtaacaagggtgaacactatcccatatcaccagctcaccgtctttcattgccatacggaactccggatgagcattcatcaggcgggcaagaatgtgaataaaggccggataaaacttgtgcttatttttctttacggtctttaaaaaggccgtaatatccagctgaacggtctggttataggtacattgagcaactgactgaaatgcctcaaaatgttctttacgatgccattgggatatatcaacggtggtatatccagtgatttttttctccattttagcttccttagctcctgaaaatctcgataactcaaaaaatacgcccggtagtgatcttatttcattatggtgaaagttggaacctcttacgtgccaagccaaataggccgt

SEQ ID NO: 70 - DNA, 5742 bp, Artificial Sequence
  Synthetic Polynucleotide
cactcggtcgctacgctccgggcgtgagactgcggcgggcgctgcggacacatacaaagttacccacagattccgtggataagcaggggactaacatgtgaggcaaaacagcagggccgcgccggtggcgtttttccataggctccgccctcctgccagagttcacataaacagacgcttttccggtgcatctgtgggagccgtgaggctcaaccatgaatctgacagtacgggcgaaacccgacaggacttaaagatccccaccgtttccggcgggtcgctccctcttgcgctctcctgttccgaccctgccgtttaccggatacctgttccgcctttctcccttacgggaagtgtggcgctttctcatagctcacacactggtatctcggctcggtgtaggtcgttcgctccaagctgggctgtaagcaagaactccccgttcagcccgactgctgcgccttatccggtaactgttcacttgagtccaacccggaaaagcacggtaaaacgccactggcagcagccattggtaactgggagttcgcagaggatttgtttagctaaacacgcggttgctcttgaagtgtgcgccaaagtccggctacactggaaggacagatttggttgctgtgctctgcgaaagccagttaccacggttaagcagttccccaactgacttaaccttcgatcaaaccacctccccaggtggttttttcgtttacagggcaaaagattacgcgcagaaaaaaaggatctcaagaagatcctttgatcttttctactgaaccgctctagatttcagtgcaatttatctcttcaaatgtagcacctgaagtcagcccaggaggaagaggacatccggtcaaataaaacgaaaggctcagtcgaaagactgggcctttcgttttagacttagggaccctttatgacaacttgacggctacatcattcactttttcttcacaaccggcacggaactcgctcgggctggccccggtgcattttttaaatacccgcgagaaatagagttgatcgtcaaaaccaacattgcgaccgacggtggcgataggcatccgggtggtgctcaaaagcagcttcgcctggctgatacgttggtcctcgcgccagcttaagacgctaatccctaactgctggcggaaaagatgtgacagacgcgacggcgacaagcaaacatgctgtgcgacgctggcgatatcaaaattgctgtctgccaggtgatcgctgatgtactgacaagcctcgcgtacccgattatccatcggtggatggagcgactcgttaatcgcttccatgcgccgcagtaacaattgctcaagcagatttatcgccagcagctccgaatagcgcccttccccttgcccggcgttaatgatttgcccaaacaggtcgctgaaatgcggctggtgcgcttcatccgggcgaaagaaccccgtattggcaaatattgacggccagttaagccattcatgccagtaggcgcgcggacgaaagtaaacccactggtgataccattcgcgagcctccggatgacgaccgtagtgatgaatctctcctggcgggaacagcaaaatatcacccggtcggcaaacaaattctcgtccctgatttttcaccaccccctgaccgcgaatggtgagattgagaatataacctttcattcccagcggtcggtcgataaaaaaatcgagataaccgttggcctcaatcggcgttaaacccgccaccagatgggcattaaacgagtatcccggcagcaggggatcattttgcgcttcagccatacttttcatactcccaccattcagagaagaaaccaattgtccatattgcatcagacattgccgtcactgcgtcttttactggctcttctcgctaacccaaccggtaaccccgcttattaaaagcattctgtaacaaagcgggaccaaagccatgacaaaaacgcgtaacaaaagtgtctataatcacggcagaaaagtccacattgattatttgcacggcgtcacactttgctatgccatagcatttttatccataagattagcggatcctacctgacgctttttatcgcaactctctactgtttctccatacccgtttttttggacgcgtacaactcaagtctgacataaatgaccgctatgagcactgcaattacacgccagatcgttctcgctaccgcaaccaccggtatgaaccagattggtgcgcactatgaaggccacaagatcattgagattggtgccgttgaagtggtgaaccgtcgcctgacgggcaataacttccatgtttatctcaaacccgatcggctggtggatccggaagcctttggcgtacatggtattgccgatgaatttttgctcgataagcccacgtttgccgaagtagccgatgagttcatggactatattcgcggcgcggagttggtgatccataacgcagcgttcgatatcggctttatggactacgagttttcgttgcttaagcgcgatattccgaagaccaatactttctgtaaggtcaccgatagccttgcggtggcgaggaaaatgtttcccggtaagcgcaacagcctcgatgcgttatgtgctcgctacgaaatagataacagtaaacgaacgctgcacggggcattactcgatgcccagatccttgcggaagtttatctggcgatgaccggtggtcaaacgtcgatggcttttgcgatggaaggagagacacaacagcaacaaggtgaagcaacaattcagcgcattgtacgtcaggcaagtaagttacgcgttgtttttgcgacagatgaagagattgcagctcatgaagcccgtctcgatctggtgcagaagaaaggcggaagttgcctctggcgagcataatttaatatcagtaaaccggacataacccatgaagaaaaatcgcgcttttttgaagtgggcagggggcaagtatcccctgcttgatgatattaaacggcatttgcccaagggcgaatgtctggttgagccttttgtaggtgccgggtcggtgtttctcaacaccgacttttctcgttatatccttgccgatatcaatagcgacctgatcagtctctataacattgtgaagatgcgtactgatgagtacgtacaggccgcacgcgagctgtttgttcccgaaacaaattgcgccgaggtttactatcagttccgcgaagagttcaacaaaagccaggatccgttccgtcgggcggtactgtttttatatttgaaccgctacggttacaacggcctgtgtcgttacaatctgcgcggtgagtttaacgtgccgttcggccgctacaaaaaaccctatttcccggaagcagagttgtatcacttcgctgaaaaagcgcagaatgcctttttctattgtgagtcttacgccgatagcatggcgcgcgcagatgatgcatccgtcgtctattgcgatccgccttatgcaccgctgtctgcgaccgccaactttacggcgtatcacacaaacagttttacgcttgaacaacaagcgcatctggcggagatcgccgaaggtctggttgagcgccatattccagtgctgatctccaatcacgatacgatgttaacgcgtgagtggtatcagcgcgcaaaattgcatgtcgtcaaagttcgacgcagtataagcagcaacggcggcacacgtaaaaaggtggacgaactgctggctttgtacaaaccaggagtcgtttcacccgcgaaaaaataattcagctaagacactgcactggattaagatgaaaacgattgaagttgatgatgaactctacagctatattgccagccacactaagcatatcggcgagagcgcatccgacattttacggcgtatgttgaaattttccgccgcatcacagcctgctgctccggtgacgaaagaggttcgcgttgcgtcacctgctatcgtcgaagcgaagccggtcaaaacgattaaagacaaggttcgcgcaatgcgtgaacttctgctttcggatgaatacgcagagcaaaagcgagcggtcaatcgctttatgctgctgttgtctacactatattctcttgacgcccaggcgtttgccgaagcaacggaatcgttgcacggtcgtacacgcgtttactttgcggcagatgaacaaacgctgctgaaaaatggtaatcagaccaagccgaaacatgtgccaggcacgccgtattgggtgatcaccaacaccaacaccggccgtaaatgcagcatgatcgaacacatcatgcagtcgatgcaattcccggcggaattgattgagaaggtttgcggaactatctaacggctgaaattaatgaggtcatacccaaatggatagttcgtttacgcccattgaacaaatgctaaaatttcgcgccagccgccacgaagattttccttatcaggagatccttctgactcgtctttgcatgcacatgcaaagcaagctgctggagaaccgcaataaaatgctgaaggctcagggaattaacgagacgttgtttatggcgttgattacgctggagtctcaggaaaaccacagtattcagccttctgaattaagttgtgctcttggatcatcccgtaccaacgcgacgcgtattgccgatgaactggaaaaacgcggttggatcgaacgtcgtgaaagcgataacgatcgccgctgcctgcatctgcaattaacggaaaaaggtcacgagtttttgcgcgaggttttaccaccgcagcataactgcctgcatcaactctggtccgcgctcagcacaacagaaaaagatcagctcgagcaaatcacccgcaaattgctctcccgtctcgaccagatggaacaagacggtgtggttctcgaagcgatgagctaaacttaattaacggcactcctcagccaagtcaaaagcctccgaccggaggcttttgactacatgcccatggcgtttacgccccgccctgccactcatcgcagtactgttgtaattcattaagcattctgccgacatggaagccatcacaaacggcatgatgaacctgaatcgccagcggcatcagcaccttgtcgccttgcgtataatatttgcccatagtgaaaacgggggcgaagaagttgtccatattggccacgtttaaatcaaaactggtgaaactcacccagggattggctgagacgaaaaacatattctcaataaaccctttagggaaataggccaggttttcaccgtaacacgccacatcttgcgaatatatgtgtagaaactgccggaaatcgtcgtggtattcactccagagcgatgaaaacgtttcagtttgctcatggaaaacggtgtaacaagggtgaacactatcccatatcaccagctcaccgtctttcattgccatacggaactccggatgagcattcatcaggcgggcaagaatgtgaataaaggccggataaaacttgtgcttatttttctttacggtctttaaaaaggccgtaatatccagctgaacggtctggttataggtacattgagtaactgactgaaatgcctcaaaatgttctttacgatgccattgggatatatcaacggtggtatatccagtgatttttttctccattttagcttccttagctcctgaaaatctcgataactcaaaaaatacgcccggtagtgatcttatttcattatggtgaaagttggaacctcttacgtgccaagccaaataggccgt

SEQ ID NO: 71 - DNA, 7483 bp, Artificial Sequence
  Synthetic Polynucleotide
cactcggtcgctacgctccgggcgtgagactgcggcgggcgctgcggacacatacaaagttacccacagattccgtggataagcaggggactaacatgtgaggcaaaacagcagggccgcgccggtggcgtttttccataggctccgccctcctgccagagttcacataaacagacgcttttccggtgcatctgtgggagccgtgaggctcaaccatgaatctgacagtacgggcgaaacccgacaggacttaaagatccccaccgtttccggcgggtcgctccctcttgcgctctcctgttccgaccctgccgtttaccggatacctgttccgcctttctcccttacgggaagtgtggcgctttctcatagctcacacactggtatctcggctcggtgtaggtcgttcgctccaagctgggctgtaagcaagaactccccgttcagcccgactgctgcgccttatccggtaactgttcacttgagtccaacccggaaaagcacggtaaaacgccactggcagcagccattggtaactgggagttcgcagaggatttgtttagctaaacacgcggttgctcttgaagtgtgcgccaaagtccggctacactggaaggacagatttggttgctgtgctctgcgaaagccagttaccacggttaagcagttccccaactgacttaaccttcgatcaaaccacctccccaggtggttttttcgtttacagggcaaaagattacgcgcagaaaaaaaggatctcaagaagatcctttgatcttttctactgaaccgctctagatttcagtgcaatttatctcttcaaatgtagcacctgaagtcagcccaggaggaagaggacatccggtcaaataaaacgaaaggctcagtcgaaagactgggcctttcgttttagacttagggaccctttatgacaacttgacggctacatcattcactttttcttcacaaccggcacggaactcgctcgggctggccccggtgcattttttaaatacccgcgagaaatagagttgatcgtcaaaaccaacattgcgaccgacggtggcgataggcatccgggtggtgctcaaaagcagcttcgcctggctgatacgttggtcctcgcgccagcttaagacgctaatccctaactgctggcggaaaagatgtgacagacgcgacggcgacaagcaaacatgctgtgcgacgctggcgatatcaaaattgctgtctgccaggtgatcgctgatgtactgacaagcctcgcgtacccgattatccatcggtggatggagcgactcgttaatcgcttccatgcgccgcagtaacaattgctcaagcagatttatcgccagcagctccgaatagcgcccttccccttgcccggcgttaatgatttgcccaaacaggtcgctgaaatgcggctggtgcgcttcatccgggcgaaagaaccccgtattggcaaatattgacggccagttaagccattcatgccagtaggcgcgcggacgaaagtaaacccactggtgataccattcgcgagcctccggatgacgaccgtagtgatgaatctctcctggcgggaacagcaaaatatcacccggtcggcaaacaaattctcgtccctgatttttcaccaccccctgaccgcgaatggtgagattgagaatataacctttcattcccagcggtcggtcgataaaaaaatcgagataaccgttggcctcaatcggcgttaaacccgccaccagatgggcattaaacgagtatcccggcagcaggggatcattttgcgcttcagccatacttttcatactcccaccattcagagaagaaaccaattgtccatattgcatcagacattgccgtcactgcgtcttttactggctcttctcgctaacccaaccggtaaccccgcttattaaaagcattctgtaacaaagcgggaccaaagccatgacaaaaacgcgtaacaaaagtgtctataatcacggcagaaaagtccacattgattatttgcacggcgtcacactttgctatgccatagcatttttatccataagattagcggatcctacctgacgctttttatcgcaactctctactgtttctccatacccgtttttttggacgcgtacaactcaagtctgacataaatgaccgctatgagcactgcaattacacgccagatcgttctcgctaccgcaaccaccggtatgaaccagattggtgcgcactatgaaggccacaagatcattgagattggtgccgttgaagtggtgaaccgtcgcctgacgggcaataacttccatgtttatctcaaacccgatcggctggtggatccggaagcctttggcgtacatggtattgccgatgaatttttgctcgataagcccacgtttgccgaagtagccgatgagttcatggactatattcgcggcgcggagttggtgatccataacgcagcgttcgatatcggctttatggactacgagttttcgttgcttaagcgcgatattccgaagaccaatactttctgtaaggtcaccgatagccttgcggtggcgaggaaaatgtttcccggtaagcgcaacagcctcgatgcgttatgtgctcgctacgaaatagataacagtaaacgaacgctgcacggggcattactcgatgcccagatccttgcggaagtttatctggcgatgaccggtggtcaaacgtcgatggcttttgcgatggaaggagagacacaacagcaacaaggtgaagcaacaattcagcgcattgtacgtcaggcaagtaagttacgcgttgtttttgcgacagatgaagagattgcagctcatgaagcccgtctcgatctggtgcagaagaaaggcggaagttgcctctggcgagcataatttaatatcagtaaaccggacataacccatgaagaaaaatcgcgcttttttgaagtgggcagggggcaagtatcccctgcttgatgatattaaacggcatttgcccaagggcgaatgtctggttgagccttttgtaggtgccgggtcggtgtttctcaacaccgacttttctcgttatatccttgccgatatcaatagcgacctgatcagtctctataacattgtgaagatgcgtactgatgagtacgtacaggccgcacgcgagctgtttgttcccgaaacaaattgcgccgaggtttactatcagttccgcgaagagttcaacaaaagccaggatccgttccgtcgggcggtactgtttttatatttgaaccgctacggttacaacggcctgtgtcgttacaatctgcgcggtgagtttaacgtgccgttcggccgctacaaaaaaccctatttcccggaagcagagttgtatcacttcgctgaaaaagcgcagaatgcctttttctattgtgagtcttacgccgatagcatggcgcgcgcagatgatgcatccgtcgtctattgcgatccgccttatgcaccgctgtctgcgaccgccaactttacggcgtatcacacaaacagttttacgcttgaacaacaagcgcatctggcggagatcgccgaaggtctggttgagcgccatattccagtgctgatctccaatcacgatacgatgttaacgcgtgagtggtatcagcgcgcaaaattgcatgtcgtcaaagttcgacgcagtataagcagcaacggcggcacacgtaaaaaggtggacgaactgctggctttgtacaaaccaggagtcgtttcacccgcgaaaaaataattcagctaagacactgcactggattaagatgaaaacgattgaagttgatgatgaactctacagctatattgccagccacactaagcatatcggcgagagcgcatccgacattttacggcgtatgttgaaattttccgccgcatcacagcctgctgctccggtgacgaaagaggttcgcgttgcgtcacctgctatcgtcgaagcgaagccggtcaaaacgattaaagacaaggttcgcgcaatgcgtgaacttctgctttcggatgaatacgcagagcaaaagcgagcggtcaatcgctttatgctgctgttgtctacactatattctcttgacgcccaggcgtttgccgaagcaacggaatcgttgcacggtcgtacacgcgtttactttgcggcagatgaacaaacgctgctgaaaaatggtaatcagaccaagccgaaacatgtgccaggcacgccgtattgggtgatcaccaacaccaacaccggccgtaaatgcagcatgatcgaacacatcatgcagtcgatgcaattcccggcggaattgattgagaaggtttgcggaactatctaatttaatatcagggaaccggacataaccccatgccggcgaccagcaaaggtccggttgagcgcaaagttgtgcgtatcgttacgccaggcaccatcagcgatgaagccctgttgcaggagcgtcaggacaacctgctggcggctatctggcaggacagcaaaggtttcggctacgcgacgctggatatcagttccgggcgttttcgcctgagcgaaccggctgaccgcgaaacgatggcggcagaactgcaacgcactaatcctgcggaactgctgtatgcagaagattttgctgaaatgtcgttaattgaaggccgtcgcggcctgcgccgtcgcccgctgtgggagtttgaaatcgacaccgcgcgccagcagttgaatctgcaatttgggacccgcgatctggtcggttttggcgtcgagaacgcgccgcgcggactttgtgctgccggttgtctgttgcagtatgcgaaagatacccaacgtacgactctgccgcatattcgttccatcaccatggaacgtgagcaggacagcatcattatggatgccgcgacgcgtcgtaatctggaaatcacccagaacctggcgggtggtgcggaaaatacgctggcttctgtgctcgactgcaccgtcacgccgatgggcagccgtatgctgaaacgctggctgcatatgccagtgcgcgatacccgcgtgttgcttgagcgccagcaaactattggcgcattgcaggatttcaccgccgggctacagccggtactgcgtcaggtcggcgacctggaacgtattctggcacgtctggctttacgaactgctcgcccacgcgatctggcccgtatgcgccacgctttccagcaactgccggagctgcgtgcgcagttagaaactgtcgatagtgcaccggtacaggcgctacgtgagaagatgggcgagtttgccgagctgcgcgatctgctggagcgagcaatcatcgacacaccgccggtgctggtacgcgacggtggtgttatcgcatcgggctataacgaagagctggatgagtggcgcgcgctggctgacggcgcgaccgattatctggagcgtctggaagtccgcgagcgtgaacgtaccggcctggacacgctgaaagttggctttaatgcggtgcacggctactacattcaaatcagccgtgggcaaagccatctggcacccatcaactacatgcgtcgccagacgctgaaaaacgccgagcgctacatcattccagagctaaaagagtacgaagataaagttctcacctcaaaaggcaaagcactggcactggaaaaacagctttatgaagagctgttcgacctgctgttgccgcatctggaagcgttgcaacagagcgcgagcgcgctggcggaactcgacgtgctggttaacctggcggaacgggcctataccctgaactacacctgcccgaccttcattgataaaccgggcattcgcattaccgaaggtcgccatccggtagttgaacaagtactgaatgagccatttatcgccaacccgctgaatctgtcgccgcagcgccgcatgttgatcatcaccggtccgaacatgggcggtaaaagtacctatatgcgccagaccgcactgattgcgctgatggcctacatcggcagctatgtaccggcacaaaaagtcgagattggacctatcgatcgcatctttacccgcgtaggcgcggcagatgacctggcgtccgggcgctcaacctttatggtggagatgactgaaaccgccaatattttacataacgccaccgaatacagtctggtgttaatggatgagatcgggcgtggaacgtccacctacgatggtctgtcgctggcgtgggcgtgcgcggaaaatctggcgaataagattaaggcattgacgttatttgctacccactatttcgagctgacccagttaccggagaaaatggaaggcgtcgctaacgtgcatctcgatgcactggagcacggcgacaccattgcctttatgcacagcgtgcaggatggcgcggcgagcaaaagctacggcctggcggttgcagctctggcaggcgtgccaaaagaggttattaagcgcgcacggcaaaagctgcgtgagctggaaagcatttcgccgaacgccgccgctacgcaagtggatggtacgcaaatgtctttgctgtcagtaccagaagaaacttcgcctgcggtcgaagctctggaaaatcttgatccggattcactcaccccgcgtcaggcgctggagtggatttatcgcttgaagagcctggtgtaaacttaattaacggcactcctcagccaagtcaaaagcctccgaccggaggcttttgactacatgcccatggcgtttacgccccgccctgccactcatcgcagtactgttgtaattcattaagcattctgccgacatggaagccatcacaaacggcatgatgaacctgaatcgccagcggcatcagcaccttgtcgccttgcgtataatatttgcccatagtgaaaacgggggcgaagaagttgtccatattggccacgtttaaatcaaaactggtgaaactcacccagggattggctgagacgaaaaacatattctcaataaaccctttagggaaataggccaggttttcaccgtaacacgccacatcttgcgaatatatgtgtagaaactgccggaaatcgtcgtggtattcactccagagcgatgaaaacgtttcagtttgctcatggaaaacggtgtaacaagggtgaacactatcccatatcaccagctcaccgtctttcattgccatacggaactccggatgagcattcatcaggcgggcaagaatgtgaataaaggccggataaaacttgtgcttatttttctttacggtctttaaaaaggccgtaatatccagctgaacggtctggttataggtacattgagtaactgactgaaatgcctcaaaatgttctttacgatgccattgggatatatcaacggtggtatatccagtgatttttttctccattttagcttccttagctcctgaaaatctcgataactcaaaaaatacgcccggtagtgatcttatttcattatggtgaaagttggaacctcttacgtgccaagccaaataggccgt

SEQ ID NO: 72 - DNA, 6267 bp, Artificial Sequence
  Synthetic Polynucleotide
cactcggtcgctacgctccgggcgtgagactgcggcgggcgctgcggacacatacaaagttacccacagattccgtggataagcaggggactaacatgtgaggcaaaacagcagggccgcgccggtggcgtttttccataggctccgccctcctgccagagttcacataaacagacgcttttccggtgcatctgtgggagccgtgaggctcaaccatgaatctgacagtacgggcgaaacccgacaggacttaaagatccccaccgtttccggcgggtcgctccctcttgcgctctcctgttccgaccctgccgtttaccggatacctgttccgcctttctcccttacgggaagtgtggcgctttctcatagctcacacactggtatctcggctcggtgtaggtcgttcgctccaagctgggctgtaagcaagaactccccgttcagcccgactgctgcgccttatccggtaactgttcacttgagtccaacccggaaaagcacggtaaaacgccactggcagcagccattggtaactgggagttcgcagaggatttgtttagctaaacacgcggttgctcttgaagtgtgcgccaaagtccggctacactggaaggacagatttggttgctgtgctctgcgaaagccagttaccacggttaagcagttccccaactgacttaaccttcgatcaaaccacctccccaggtggttttttcgtttacagggcaaaagattacgcgcagaaaaaaaggatctcaagaagatcctttgatcttttctactgaaccgctctagatttcagtgcaatttatctcttcaaatgtagcacctgaagtcagcccaggaggaagaggacatccggtcaaataaaacgaaaggctcagtcgaaagactgggcctttcgttttagacttagggaccctttatgacaacttgacggctacatcattcactttttcttcacaaccggcacggaactcgctcgggctggccccggtgcattttttaaatacccgcgagaaatagagttgatcgtcaaaaccaacattgcgaccgacggtggcgataggcatccgggtggtgctcaaaagcagcttcgcctggctgatacgttggtcctcgcgccagcttaagacgctaatccctaactgctggcggaaaagatgtgacagacgcgacggcgacaagcaaacatgctgtgcgacgctggcgatatcaaaattgctgtctgccaggtgatcgctgatgtactgacaagcctcgcgtacccgattatccatcggtggatggagcgactcgttaatcgcttccatgcgccgcagtaacaattgctcaagcagatttatcgccagcagctccgaatagcgcccttccccttgcccggcgttaatgatttgcccaaacaggtcgctgaaatgcggctggtgcgcttcatccgggcgaaagaaccccgtattggcaaatattgacggccagttaagccattcatgccagtaggcgcgcggacgaaagtaaacccactggtgataccattcgcgagcctccggatgacgaccgtagtgatgaatctctcctggcgggaacagcaaaatatcacccggtcggcaaacaaattctcgtccctgatttttcaccaccccctgaccgcgaatggtgagattgagaatataacctttcattcccagcggtcggtcgataaaaaaatcgagataaccgttggcctcaatcggcgttaaacccgccaccagatgggcattaaacgagtatcccggcagcaggggatcattttgcgcttcagccatacttttcatactcccaccattcagagaagaaaccaattgtccatattgcatcagacattgccgtcactgcgtcttttactggctcttctcgctaacccaaccggtaaccccgcttattaaaagcattctgtaacaaagcgggaccaaagccatgacaaaaacgcgtaacaaaagtgtctataatcacggcagaaaagtccacattgattatttgcacggcgtcacactttgctatgccatagcatttttatccataagattagcggatcctacctgacgctttttatcgcaactctctactgtttctccatacccgtttttttggacgcgtacaactcaagtctgacataaatgaccgctatgagcactgcaattacacgccagatcgttctcgctaccgcaaccaccggtatgaaccagattggtgcgcactatgaaggccacaagatcattgagattggtgccgttgaagtggtgaaccgtcgcctgacgggcaataacttccatgtttatctcaaacccgatcggctggtggatccggaagcctttggcgtacatggtattgccgatgaatttttgctcgataagcccacgtttgccgaagtagccgatgagttcatggactatattcgcggcgcggagttggtgatccataacgcagcgttcgatatcggctttatggactacgagttttcgttgcttaagcgcgatattccgaagaccaatactttctgtaaggtcaccgatagccttgcggtggcgaggaaaatgtttcccggtaagcgcaacagcctcgatgcgttatgtgctcgctacgaaatagataacagtaaacgaacgctgcacggggcattactcgatgcccagatccttgcggaagtttatctggcgatgaccggtggtcaaacgtcgatggcttttgcgatggaaggagagacacaacagcaacaaggtgaagcaacaattcagcgcattgtacgtcaggcaagtaagttacgcgttgtttttgcgacagatgaagagattgcagctcatgaagcccgtctcgatctggtgcagaagaaaggcggaagttgcctctggcgagcataatttaatatcagtaaaccggacataacccatgaagaaaaatcgcgcttttttgaagtgggcagggggcaagtatcccctgcttgatgatattaaacggcatttgcccaagggcgaatgtctggttgagccttttgtaggtgccgggtcggtgtttctcaacaccgacttttctcgttatatccttgccgatatcaatagcgacctgatcagtctctataacattgtgaagatgcgtactgatgagtacgtacaggccgcacgcgagctgtttgttcccgaaacaaattgcgccgaggtttactatcagttccgcgaagagttcaacaaaagccaggatccgttccgtcgggcggtactgtttttatatttgaaccgctacggttacaacggcctgtgtcgttacaatctgcgcggtgagtttaacgtgccgttcggccgctacaaaaaaccctatttcccggaagcagagttgtatcacttcgctgaaaaagcgcagaatgcctttttctattgtgagtcttacgccgatagcatggcgcgcgcagatgatgcatccgtcgtctattgcgatccgccttatgcaccgctgtctgcgaccgccaactttacggcgtatcacacaaacagttttacgcttgaacaacaagcgcatctggcggagatcgccgaaggtctggttgagcgccatattccagtgctgatctccaatcacgatacgatgttaacgcgtgagtggtatcagcgcgcaaaattgcatgtcgtcaaagttcgacgcagtataagcagcaacggcggcacacgtaaaaaggtggacgaactgctggctttgtacaaaccaggagtcgtttcacccgcgaaaaaataattcagctaagacactgcactggattaagatgaaaacgattgaagttgatgatgaactctacagctatattgccagccacactaagcatatcggcgagagcgcatccgacattttacggcgtatgttgaaattttccgccgcatcacagcctgctgctccggtgacgaaagaggttcgcgttgcgtcacctgctatcgtcgaagcgaagccggtcaaaacgattaaagacaaggttcgcgcaatgcgtgaacttctgctttcggatgaatacgcagagcaaaagcgagcggtcaatcgctttatgctgctgttgtctacactatattctcttgacgcccaggcgtttgccgaagcaacggaatcgttgcacggtcgtacacgcgtttactttgcggcagatgaacaaacgctgctgaaaaatggtaatcagaccaagccgaaacatgtgccaggcacgccgtattgggtgatcaccaacaccaacaccggccgtaaatgcagcatgatcgaacacatcatgcagtcgatgcaattcccggcggaattgattgagaaggtttgcggaactatctaaatactttaccagtgttgagaggtgagcaatgcgtaaaatcattcatgtggatatggactgctttttcgccgcagtggagatgcgcgacaatcccgccctgcgcgatatccctattgctattggcggcagccgcgaacgtcggggggtgatcagcaccgccaattatcccgcgcgtaaatttggcgtacgtagcgctatgccgacagggatggcgctcaaattatgcccacatctcaccttgcttccggggcgctttgacgcctacaaagaagcctcaaatcatatccgtgaaatcttctcgcgctacacctcgcgcattgaaccgttgtcactggatgaggcttatctcgatgtcaccgatagcgtccattgccacggttctgcgaccctcatcgcccaggaaatccgccagacaatcttcaacgagctgcaactgacggcgtctgcgggcgtggcaccagtaaagtttctcgccaaaatcgcctccgacatgaataaacccaacggccagtttgtgattacgccggcagaagttccggcatttttacaaaccttaccgctggcaaaaatccccggcgtcggcaaagtctcagcggcaaaactggaagcgatggggctgcggacctgcggtgatgtacaaaagtgtgatctggtgatgctgcttaaacgctttggcaaatttggccgcattttgtgggagcgtagtcaggggattgacgaacgcgatgttaacagcgaacggttgcgaaaatccgtcggcgtggaacgcacgatggcggaagatattcatcactggtctgaatgtgaagcgattatcgagcggctgtatccggaacttgaacgccgtctggcaaaggtaaaacctgatttactgattgctcgccagggggtgaaattaaagttcgacgattttcagcaaaccacccaggagcacgtctggccgcggctgaataaagctgatctaatcgccaccgcgcgtaaaacctgggatgaacgccgcggcgggcgcggtgtgcgtctggtggggctgcatgtgacgttgcttgacccgcaaatggaaagacaactggtgctgggattatgaacttaattaacggcactcctcagccaagtcaaaagcctccgaccggaggcttttgactacatgcccatggcgtttacgccccgccctgccactcatcgcagtactgttgtaattcattaagcattctgccgacatggaagccatcacaaacggcatgatgaacctgaatcgccagcggcatcagcaccttgtcgccttgcgtataatatttgcccatagtgaaaacgggggcgaagaagttgtccatattggccacgtttaaatcaaaactggtgaaactcacccagggattggctgagacgaaaaacatattctcaataaaccctttagggaaataggccaggttttcaccgtaacacgccacatcttgcgaatatatgtgtagaaactgccggaaatcgtcgtggtattcactccagagcgatgaaaacgtttcagtttgctcatggaaaacggtgtaacaagggtgaacactatcccatatcaccagctcaccgtctttcattgccatacggaactccggatgagcattcatcaggcgggcaagaatgtgaataaaggccggataaaacttgtgcttatttttctttacggtctttaaaaaggccgtaatatccagctgaacggtctggttataggtacattgagtaactgactgaaatgcctcaaaatgttctttacgatgccattgggatatatcaacggtggtatatccagtgatttttttctccattttagcttccttagctcctgaaaatctcgataactcaaaaaatacgcccggtagtgatcttatttcattatggtgaaagttggaacctcttacgtgccaagccaaataggccgt

SEQ ID NO: 73 - DNA, 7563 bp, Artificial Sequence
  Synthetic Polynucleotide
cactcggtcgctacgctccgggcgtgagactgcggcgggcgctgcggacacatacaaagttacccacagattccgtggataagcaggggactaacatgtgaggcaaaacagcagggccgcgccggtggcgtttttccataggctccgccctcctgccagagttcacataaacagacgcttttccggtgcatctgtgggagccgtgaggctcaaccatgaatctgacagtacgggcgaaacccgacaggacttaaagatccccaccgtttccggcgggtcgctccctcttgcgctctcctgttccgaccctgccgtttaccggatacctgttccgcctttctcccttacgggaagtgtggcgctttctcatagctcacacactggtatctcggctcggtgtaggtcgttcgctccaagctgggctgtaagcaagaactccccgttcagcccgactgctgcgccttatccggtaactgttcacttgagtccaacccggaaaagcacggtaaaacgccactggcagcagccattggtaactgggagttcgcagaggatttgtttagctaaacacgcggttgctcttgaagtgtgcgccaaagtccggctacactggaaggacagatttggttgctgtgctctgcgaaagccagttaccacggttaagcagttccccaactgacttaaccttcgatcaaaccacctccccaggtggttttttcgtttacagggcaaaagattacgcgcagaaaaaaaggatctcaagaagatcctttgatcttttctactgaaccgctctagatttcagtgcaatttatctcttcaaatgtagcacctgaagtcagcccaggaggaagaggacatccggtcaaataaaacgaaaggctcagtcgaaagactgggcctttcgttttagacttagggaccctttatgacaacttgacggctacatcattcactttttcttcacaaccggcacggaactcgctcgggctggccccggtgcattttttaaatacccgcgagaaatagagttgatcgtcaaaaccaacattgcgaccgacggtggcgataggcatccgggtggtgctcaaaagcagcttcgcctggctgatacgttggtcctcgcgccagcttaagacgctaatccctaactgctggcggaaaagatgtgacagacgcgacggcgacaagcaaacatgctgtgcgacgctggcgatatcaaaattgctgtctgccaggtgatcgctgatgtactgacaagcctcgcgtacccgattatccatcggtggatggagcgactcgttaatcgcttccatgcgccgcagtaacaattgctcaagcagatttatcgccagcagctccgaatagcgcccttccccttgcccggcgttaatgatttgcccaaacaggtcgctgaaatgcggctggtgcgcttcatccgggcgaaagaaccccgtattggcaaatattgacggccagttaagccattcatgccagtaggcgcgcggacgaaagtaaacccactggtgataccattcgcgagcctccggatgacgaccgtagtgatgaatctctcctggcgggaacagcaaaatatcacccggtcggcaaacaaattctcgtccctgatttttcaccaccccctgaccgcgaatggtgagattgagaatataacctttcattcccagcggtcggtcgataaaaaaatcgagataaccgttggcctcaatcggcgttaaacccgccaccagatgggcattaaacgagtatcccggcagcaggggatcattttgcgcttcagccatacttttcatactcccaccattcagagaagaaaccaattgtccatattgcatcagacattgccgtcactgcgtcttttactggctcttctcgctaacccaaccggtaaccccgcttattaaaagcattctgtaacaaagcgggaccaaagccatgacaaaaacgcgtaacaaaagtgtctataatcacggcagaaaagtccacattgattatttgcacggcgtcacactttgctatgccatagcatttttatccataagattagcggatcctacctgacgctttttatcgcaactctctactgtttctccatacccgtttttttggacgcgtacaactcaagtctgacataaatgaccgctatgagcactgcaattacacgccagatcgttctcgctaccgcaaccaccggtatgaaccagattggtgcgcactatgaaggccacaagatcattgagattggtgccgttgaagtggtgaaccgtcgcctgacgggcaataacttccatgtttatctcaaacccgatcggctggtggatccggaagcctttggcgtacatggtattgccgatgaatttttgctcgataagcccacgtttgccgaagtagccgatgagttcatggactatattcgcggcgcggagttggtgatccataacgcagcgttcgatatcggctttatggactacgagttttcgttgcttaagcgcgatattccgaagaccaatactttctgtaaggtcaccgatagccttgcggtggcgaggaaaatgtttcccggtaagcgcaacagcctcgatgcgttatgtgctcgctacgaaatagataacagtaaacgaacgctgcacggggcattactcgatgcccagatccttgcggaagtttatctggcgatgaccggtggtcaaacgtcgatggcttttgcgatggaaggagagacacaacagcaacaaggtgaagcaacaattcagcgcattgtacgtcaggcaagtaagttacgcgttgtttttgcgacagatgaagagattgcagctcatgaagcccgtctcgatctggtgcagaagaaaggcggaagttgcctctggcgagcataatttaatatcagtaaaccggacataacccatgaagaaaaatcgcgcttttttgaagtgggcagggggcaagtatcccctgcttgatgatattaaacggcatttgcccaagggcgaatgtctggttgagccttttgtaggtgccgggtcggtgtttctcaacaccgacttttctcgttatatccttgccgatatcaatagcgacctgatcagtctctataacattgtgaagatgcgtactgatgagtacgtacaggccgcacgcgagctgtttgttcccgaaacaaattgcgccgaggtttactatcagttccgcgaagagttcaacaaaagccaggatccgttccgtcgggcggtactgtttttatatttgaaccgctacggttacaacggcctgtgtcgttacaatctgcgcggtgagtttaacgtgccgttcggccgctacaaaaaaccctatttcccggaagcagagttgtatcacttcgctgaaaaagcgcagaatgcctttttctattgtgagtcttacgccgatagcatggcgcgcgcagatgatgcatccgtcgtctattgcgatccgccttatgcaccgctgtctgcgaccgccaactttacggcgtatcacacaaacagttttacgcttgaacaacaagcgcatctggcggagatcgccgaaggtctggttgagcgccatattccagtgctgatctccaatcacgatacgatgttaacgcgtgagtggtatcagcgcgcaaaattgcatgtcgtcaaagttcgacgcagtataagcagcaacggcggcacacgtaaaaaggtggacgaactgctggctttgtacaaaccaggagtcgtttcacccgcgaaaaaataattcagctaagacactgcactggattaagatgaaaacgattgaagttgatgatgaactctacagctatattgccagccacactaagcatatcggcgagagcgcatccgacattttacggcgtatgttgaaattttccgccgcatcacagcctgctgctccggtgacgaaagaggttcgcgttgcgtcacctgctatcgtcgaagcgaagccggtcaaaacgattaaagacaaggttcgcgcaatgcgtgaacttctgctttcggatgaatacgcagagcaaaagcgagcggtcaatcgctttatgctgctgttgtctacactatattctcttgacgcccaggcgtttgccgaagcaacggaatcgttgcacggtcgtacacgcgtttactttgcggcagatgaacaaacgctgctgaaaaatggtaatcagaccaagccgaaacatgtgccaggcacgccgtattgggtgatcaccaacaccaacaccggccgtaaatgcagcatgatcgaacacatcatgcagtcgatgcaattcccggcggaattgattgagaaggtttgcggaactatctaaaagcctggttttttgatggaattacagcatggcgcaggcaggttttatcttaacccgacactggcgggacaccccgcaagggacagaagtctccttctggctggcgacggacaacgggccgttgcaggttacgcttgcaccgcaagagtccgtggcgtttattcccgccgatcaggttccccgcgctcagcatattttgcagggtgaacaaggcgttcgcctgacaccgctggcgttaaaggattttcaccgccagccggtgtatggcctttactgtcgcgcccatcgccaattgatgaattacgaaaagcgcctgcgtgaaggtggcgttaccgtctacgaggccgatgtgcgcccgccagaacgctatctgatggagcggtttatcacctcaccggtgtgggtcgagggtgatatgcacaatggcgctatcgttaatgcccgtctgaaaccgcatcccgactatcgtccgccgctcaagtgggtttctattgatattgaaaccacccgccacggtgagctgtactgcatcggcctggaaggctgcgggcagcgcatcgtttatatgctggggccagagaatggcgacgcctccgcgctcgattttgaactggaatacgtcgccagccgcccgcagctactggaaaaactcaacgcctggtttgccaactacgatcctgatgtgatcatcggttggaacgtggtgcagttcgatctgcgaatgctgcaaaaacatgccgagcgttaccgtattccgctgcggctggggcgcgataacagtgagctggagtggcgcgagcacggctttaaaaacggcgtcttttttgcccaggctaaaggtcggctaattatcgacggtatcgaggcgctgaaatccgcgttctggaatttctcttcattctcgctggaaaccgtcgctcaggagttattaggcgaaggaaaatctatcgataacccgtgggatcgaatggacgaaattgaccgccgtttcgccgaagataaacctgcgctggcgacttataacctgaaagattgcgagctggtgacgcagattttccataaaactgaaatcatgccatttttactcgaacgagcgacggtgaacggcctgccggtagaccgccacgggggatcggtggcggcgtttggtcatctctattttcctcgtatgcaccgcgctggttatgtcgcgcctaatctcggcgaagtgccgccacacgccagccctggcggctacgtgatggattcacggccagggctttatgattcggtactggtgctggactataaaagcctgtacccgtcgatcatccgcacctttctgattgatcccgtcgggctggtggaaggcatggcgcagcctgatccagagcacagtaccgaaggttttctcgatgcctggttctcgcgagaaaaacattgcctgccggagattgtgactaacatctggcacgggcgcgatgaagccaaacgccagggtaacaaaccgctgtcgcaggcgctgaaaatcatcatgaatgccttttatggcgtgctcggcaccaccgcctgccgcttcttcgatccgcggctggcatcgtcgatcaccatgcgtggtcatcagatcatgcggcaaaccaaagcgttgattgaagcacagggctacgacgttatctacggcgataccgactcaacgtttgtctggctgaaaggcgcacattcggaagaagaagcggcgaaaatcggtcgtgcactggtgcagcacgttaacgcctggtgggcggaaacgctgcaaaaacaacggctgaccagcgcattagaactggagtatgaaacccatttctgccgttttctgatgccaaccattcgcggagccgataccggcagtaaaaagcgttatgccggactgattcaggagggcgacaagcagcggatggtgtttaaagggctggaaaccgtgcgcaccgactggacgccgctggcccagcagtttcagcaggagctatacctgcgcatcttccgcaacgagccatatcaggaatatgtacgcgaaaccatcgacaaactgatggcgggtgaactggatgcgcgactggtttaccgtaaacgccttcgccgtccgctgagcgagtatcagcgtaatgtgccgcctcatgtacgcgccgctcgccttgccgatgaagaaaaccaaaagcgtggtcgccccttgcaatatcagaatcgcggcaccattaagtacgtatggaccaccaacggcccggagccgctggactaccaacgttcaccactggattacgaacactatctgacccgccagctacaacccgtggcggagggaatactcccttttattgaggataattttgctacacttatgaccgggcaacttgggctattttaaacttaattaacggcactcctcagccaagtcaaaagcctccgaccggaggcttttgactacatgcccatggcgtttacgccccgccctgccactcatcgcagtactgttgtaattcattaagcattctgccgacatggaagccatcacaaacggcatgatgaacctgaatcgccagcggcatcagcaccttgtcgccttgcgtataatatttgcccatagtgaaaacgggggcgaagaagttgtccatattggccacgtttaaatcaaaactggtgaaactcacccagggattggctgagacgaaaaacatattctcaataaaccctttagggaaataggccaggttttcaccgtaacacgccacatcttgcgaatatatgtgtagaaactgccggaaatcgtcgtggtattcactccagagcgatgaaaacgtttcagtttgctcatggaaaacggtgtaacaagggtgaacactatcccatatcaccagctcaccgtctttcattgccatacggaactccggatgagcattcatcaggcgggcaagaatgtgaataaaggccggataaaacttgtgcttatttttctttacggtctttaaaaaggccgtaatatccagctgaacggtctggttataggtacattgagtaactgactgaaatgcctcaaaatgttctttacgatgccattgggatatatcaacggtggtatatccagtgatttttttctccattttagcttccttagctcctgaaaatctcgataactcaaaaaatacgcccggtagtgatcttatttcattatggtgaaagttggaacctcttacgtgccaagccaaataggccgt

SEQ ID NO: 74 - DNA, 5183 bp, Artificial Sequence
  Synthetic Polynucleotide
cactcggtcgctacgctccgggcgtgagactgcggcgggcgctgcggacacatacaaagttacccacagattccgtggataagcaggggactaacatgtgaggcaaaacagcagggccgcgccggtggcgtttttccataggctccgccctcctgccagagttcacataaacagacgcttttccggtgcatctgtgggagccgtgaggctcaaccatgaatctgacagtacgggcgaaacccgacaggacttaaagatccccaccgtttccggcgggtcgctccctcttgcgctctcctgttccgaccctgccgtttaccggatacctgttccgcctttctcccttacgggaagtgtggcgctttctcatagctcacacactggtatctcggctcggtgtaggtcgttcgctccaagctgggctgtaagcaagaactccccgttcagcccgactgctgcgccttatccggtaactgttcacttgagtccaacccggaaaagcacggtaaaacgccactggcagcagccattggtaactgggagttcgcagaggatttgtttagctaaacacgcggttgctcttgaagtgtgcgccaaagtccggctacactggaaggacagatttggttgctgtgctctgcgaaagccagttaccacggttaagcagttccccaactgacttaaccttcgatcaaaccacctccccaggtggttttttcgtttacagggcaaaagattacgcgcagaaaaaaaggatctcaagaagatcctttgatcttttctactgaaccgctctagatttcagtgcaatttatctcttcaaatgtagcacctgaagtcagcccaggaggaagaggacatccggtcaaataaaacgaaaggctcagtcgaaagactgggcctttcgttttagacttagggaccctttatgacaacttgacggctacatcattcactttttcttcacaaccggcacggaactcgctcgggctggccccggtgcattttttaaatacccgcgagaaatagagttgatcgtcaaaaccaacattgcgaccgacggtggcgataggcatccgggtggtgctcaaaagcagcttcgcctggctgatacgttggtcctcgcgccagcttaagacgctaatccctaactgctggcggaaaagatgtgacagacgcgacggcgacaagcaaacatgctgtgcgacgctggcgatatcaaaattgctgtctgccaggtgatcgctgatgtactgacaagcctcgcgtacccgattatccatcggtggatggagcgactcgttaatcgcttccatgcgccgcagtaacaattgctcaagcagatttatcgccagcagctccgaatagcgcccttccccttgcccggcgttaatgatttgcccaaacaggtcgctgaaatgcggctggtgcgcttcatccgggcgaaagaaccccgtattggcaaatattgacggccagttaagccattcatgccagtaggcgcgcggacgaaagtaaacccactggtgataccattcgcgagcctccggatgacgaccgtagtgatgaatctctcctggcgggaacagcaaaatatcacccggtcggcaaacaaattctcgtccctgatttttcaccaccccctgaccgcgaatggtgagattgagaatataacctttcattcccagcggtcggtcgataaaaaaatcgagataaccgttggcctcaatcggcgttaaacccgccaccagatgggcattaaacgagtatcccggcagcaggggatcattttgcgcttcagccatacttttcatactcccaccattcagagaagaaaccaattgtccatattgcatcagacattgccgtcactgcgtcttttactggctcttctcgctaacccaaccggtaaccccgcttattaaaagcattctgtaacaaagcgggaccaaagccatgacaaaaacgcgtaacaaaagtgtctataatcacggcagaaaagtccacattgattatttgcacggcgtcacactttgctatgccatagcatttttatccataagattagcggatcctacctgacgctttttatcgcaactctctactgtttctccatacccgtttttttggacgcgtacaactcaagtctgacataaatgaccgctatgagcactgcaattacacgccagatcgttctcgctaccgcaaccaccggtatgaaccagattggtgcgcactatgaaggccacaagatcattgagattggtgccgttgaagtggtgaaccgtcgcctgacgggcaataacttccatgtttatctcaaacccgatcggctggtggatccggaagcctttggcgtacatggtattgccgatgaatttttgctcgataagcccacgtttgccgaagtagccgatgagttcatggactatattcgcggcgcggagttggtgatccataacgcagcgttcgatatcggctttatggactacgagttttcgttgcttaagcgcgatattccgaagaccaatactttctgtaaggtcaccgatagccttgcggtggcgaggaaaatgtttcccggtaagcgcaacagcctcgatgcgttatgtgctcgctacgaaatagataacagtaaacgaacgctgcacggggcattactcgatgcccagatccttgcggaagtttatctggcgatgaccggtggtcaaacgtcgatggcttttgcgatggaaggagagacacaacagcaacaaggtgaagcaacaattcagcgcattgtacgtcaggcaagtaagttacgcgttgtttttgcgacagatgaagagattgcagctcatgaagcccgtctcgatctggtgcagaagaaaggcggaagttgcctctggcgagcataatttaatatcagtaaaccggacataacccatgaagaaaaatcgcgcttttttgaagtgggcagggggcaagtatcccctgcttgatgatattaaacggcatttgcccaagggcgaatgtctggttgagccttttgtaggtgccgggtcggtgtttctcaacaccgacttttctcgttatatccttgccgatatcaatagcgacctgatcagtctctataacattgtgaagatgcgtactgatgagtacgtacaggccgcacgcgagctgtttgttcccgaaacaaattgcgccgaggtttactatcagttccgcgaagagttcaacaaaagccaggatccgttccgtcgggcggtactgtttttatatttgaaccgctacggttacaacggcctgtgtcgttacaatctgcgcggtgagtttaacgtgccgttcggccgctacaaaaaaccctatttcccggaagcagagttgtatcacttcgctgaaaaagcgcagaatgcctttttctattgtgagtcttacgccgatagcatggcgcgcgcagatgatgcatccgtcgtctattgcgatccgccttatgcaccgctgtctgcgaccgccaactttacggcgtatcacacaaacagttttacgcttgaacaacaagcgcatctggcggagatcgccgaaggtctggttgagcgccatattccagtgctgatctccaatcacgatacgatgttaacgcgtgagtggtatcagcgcgcaaaattgcatgtcgtcaaagttcgacgcagtataagcagcaacggcggcacacgtaaaaaggtggacgaactgctggctttgtacaaaccaggagtcgtttcacccgcgaaaaaataattcagctaagacactgaggaggattaagatgaaaacgattgaagttgatgatgaactctacagctatattgccagccacactaagcatatcggcgagagcgcatccgacattttacggcgtatgttgaaattttccgccgcatcacagcctgctgctccggtgacgaaagaggttcgcgttgcgtcacctgctatcgtcgaagcgaagccggtcaaaacgattaaagacaaggttcgcgcaatgcgtgaacttctgctttcggatgaatacgcagagcaaaagcgagcggtcaatcgctttatgctgctgttgtctacactatattctcttgacgcccaggcgtttgccgaagcaacggaatcgttgcacggtcgtacacgcgtttactttgcggcagatgaacaaacgctgctgaaaaatggtaatcagaccaagccgaaacatgtgccaggcacgccgtattgggtgatcaccaacaccaacaccggccgtaaatgcagcatgatcgaacacatcatgcagtcgatgcaattcccggcggaattgattgagaaggtttgcggaactatctaaacttaattaacggcactcctcagccaagtcaaaagcctccgaccggaggcttttgactacatgcccatggcgtttacgccccgccctgccactcatcgcagtactgttgtaattcattaagcattctgccgacatggaagccatcacaaacggcatgatgaacctgaatcgccagcggcatcagcaccttgtcgccttgcgtataatatttgcccatagtgaaaacgggggcgaagaagttgtccatattggccacgtttaaatcaaaactggtgaaactcacccagggattggctgagacgaaaaacatattctcaataaaccctttagggaaataggccaggttttcaccgtaacacgccacatcttgcgaatatatgtgtagaaactgccggaaatcgtcgtggtattcactccagagcgatgaaaacgtttcagtttgctcatggaaaacggtgtaacaagggtgaacactatcccatatcaccagctcaccgtctttcattgccatacggaactccggatgagcattcatcaggcgggcaagaatgtgaataaaggccggataaaacttgtgcttatttttctttacggtctttaaaaaggccgtaatatccagctgaacggtctggttataggtacattgagtaactgactgaaatgcctcaaaatgttctttacgatgccattgggatatatcaacggtggtatatccagtgatttttttctccattttagcttccttagctcctgaaaatctcgataactcaaaaaatacgcccggtagtgatcttatttcattatggtgaaagttggaacctcttacgtgccaagccaaataggccgt

SEQ ID NO: 75 - DNA, 5168 bp, Artificial Sequence
  Synthetic Polynucleotide
cactcggtcgctacgctccgggcgtgagactgcggcgggcgctgcggacacatacaaagttacccacagattccgtggataagcaggggactaacatgtgaggcaaaacagcagggccgcgccggtggcgtttttccataggctccgccctcctgccagagttcacataaacagacgcttttccggtgcatctgtgggagccgtgaggctcaaccatgaatctgacagtacgggcgaaacccgacaggacttaaagatccccaccgtttccggcgggtcgctccctcttgcgctctcctgttccgaccctgccgtttaccggatacctgttccgcctttctcccttacgggaagtgtggcgctttctcatagctcacacactggtatctcggctcggtgtaggtcgttcgctccaagctgggctgtaagcaagaactccccgttcagcccgactgctgcgccttatccggtaactgttcacttgagtccaacccggaaaagcacggtaaaacgccactggcagcagccattggtaactgggagttcgcagaggatttgtttagctaaacacgcggttgctcttgaagtgtgcgccaaagtccggctacactggaaggacagatttggttgctgtgctctgcgaaagccagttaccacggttaagcagttccccaactgacttaaccttcgatcaaaccacctccccaggtggttttttcgtttacagggcaaaagattacgcgcagaaaaaaaggatctcaagaagatcctttgatcttttctactgaaccgctctagatttcagtgcaatttatctcttcaaatgtagcacctgaagtcagcccaggaggaagaggacatccggtcaaataaaacgaaaggctcagtcgaaagactgggcctttcgttttagacttagggaccctttatgacaacttgacggctacatcattcactttttcttcacaaccggcacggaactcgctcgggctggccccggtgcattttttaaatacccgcgagaaatagagttgatcgtcaaaaccaacattgcgaccgacggtggcgataggcatccgggtggtgctcaaaagcagcttcgcctggctgatacgttggtcctcgcgccagcttaagacgctaatccctaactgctggcggaaaagatgtgacagacgcgacggcgacaagcaaacatgctgtgcgacgctggcgatatcaaaattgctgtctgccaggtgatcgctgatgtactgacaagcctcgcgtacccgattatccatcggtggatggagcgactcgttaatcgcttccatgcgccgcagtaacaattgctcaagcagatttatcgccagcagctccgaatagcgcccttccccttgcccggcgttaatgatttgcccaaacaggtcgctgaaatgcggctggtgcgcttcatccgggcgaaagaaccccgtattggcaaatattgacggccagttaagccattcatgccagtaggcgcgcggacgaaagtaaacccactggtgataccattcgcgagcctccggatgacgaccgtagtgatgaatctctcctggcgggaacagcaaaatatcacccggtcggcaaacaaattctcgtccctgatttttcaccaccccctgaccgcgaatggtgagattgagaatataacctttcattcccagcggtcggtcgataaaaaaatcgagataaccgttggcctcaatcggcgttaaacccgccaccagatgggcattaaacgagtatcccggcagcaggggatcattttgcgcttcagccatacttttcatactcccaccattcagagaagaaaccaattgtccatattgcatcagacattgccgtcactgcgtcttttactggctcttctcgctaacccaaccggtaaccccgcttattaaaagcattctgtaacaaagcgggaccaaagccatgacaaaaacgcgtaacaaaagtgtctataatcacggcagaaaagtccacattgattatttgcacggcgtcacactttgctatgccatagcatttttatccataagattagcggatcctacctgacgctttttatcgcaactctctactgtttctccatacccgtttttttggacgcgtacaactcaagtctgacataaatgaccgctatgagcactgcaattacacgccagatcgttctcgctaccgcaaccaccggtatgaaccagattggtgcgcactatgaaggccacaagatcattgagattggtgccgttgaagtggtgaaccgtcgcctgacgggcaataacttccatgtttatctcaaacccgatcggctggtggatccggaagcctttggcgtacatggtattgccgatgaatttttgctcgataagcccacgtttgccgaagtagccgatgagttcatggactatattcgcggcgcggagttggtgatccataacgcagcgttcgatatcggctttatggactacgagttttcgttgcttaagcgcgatattccgaagaccaatactttctgtaaggtcaccgatagccttgcggtggcgaggaaaatgtttcccggtaagcgcaacagcctcgatgcgttatgtgctcgctacgaaatagataacagtaaacgaacgctgcacggggcattactcgatgcccagatccttgcggaagtttatctggcgatgaccggtggtcaaacgtcgatggcttttgcgatggaaggagagacacaacagcaacaaggtgaagcaacaattcagcgcattgtacgtcaggcaagtaagttacgcgttgtttttgcgacagatgaagagattgcagctcatgaagcccgtctcgatctggtgcagaagaaaggcggaagttgcctctggcgagcataatttaatatcagtaaaccggacataacccatgaagaaaaatcgcgcttttttgaagtgggcagggggcaagtatcccctgcttgatgatattaaacggcatttgcccaagggcgaatgtctggttgagccttttgtaggtgccgggtcggtgtttctcaacaccgacttttctcgttatatccttgccgatatcaatagcgacctgatcagtctctataacattgtgaagatgcgtactgatgagtacgtacaggccgcacgcgagctgtttgttcccgaaacaaattgcgccgaggtttactatcagttccgcgaagagttcaacaaaagccaggatccgttccgtcgggcggtactgtttttatatttgaaccgctacggttacaacggcctgtgtcgttacaatctgcgcggtgagtttaacgtgccgttcggccgctacaaaaaaccctatttcccggaagcagagttgtatcacttcgctgaaaaagcgcagaatgcctttttctattgtgagtcttacgccgatagcatggcgcgcgcagatgatgcatccgtcgtctattgcgatccgccttatgcaccgctgtctgcgaccgccaactttacggcgtatcacacaaacagttttacgcttgaacaacaagcgcatctggcggagatcgccgaaggtctggttgagcgccatattccagtgctgatctccaatcacgatacgatgttaacgcgtgagtggtatcagcgcgcaaaattgcatgtcgtcaaagttcgacgcagtataagcagcaacggcggcacacgtaaaaaggtggacgaactgctggctttgtacaaaccaggagtcgtttcacccgcgaaaaaataacggctgaaattaatgaggtcatacccaaatggatagttcgtttacgcccattgaacaaatgctaaaatttcgcgccagccgccacgaagattttccttatcaggagatccttctgactcgtctttgcatgcacatgcaaagcaagctgctggagaaccgcaataaaatgctgaaggctcagggaattaacgagacgttgtttatggcgttgattacgctggagtctcaggaaaaccacagtattcagccttctgaattaagttgtgctcttggatcatcccgtaccaacgcgacgcgtattgccgatgaactggaaaaacgcggttggatcgaacgtcgtgaaagcgataacgatcgccgctgcctgcatctgcaattaacggaaaaaggtcacgagtttttgcgcgaggttttaccaccgcagcataactgcctgcatcaactctggtccgcgctcagcacaacagaaaaagatcagctcgagcaaatcacccgcaaattgctctcccgtctcgaccagatggaacaagacggtgtggttctcgaagcgatgagctaaacttaattaacggcactcctcagccaagtcaaaagcctccgaccggaggcttttgactacatgcccatggcgtttacgccccgccctgccactcatcgcagtactgttgtaattcattaagcattctgccgacatggaagccatcacaaacggcatgatgaacctgaatcgccagcggcatcagcaccttgtcgccttgcgtataatatttgcccatagtgaaaacgggggcgaagaagttgtccatattggccacgtttaaatcaaaactggtgaaactcacccagggattggctgagacgaaaaacatattctcaataaaccctttagggaaataggccaggttttcaccgtaacacgccacatcttgcgaatatatgtgtagaaactgccggaaatcgtcgtggtattcactccagagcgatgaaaacgtttcagtttgctcatggaaaacggtgtaacaagggtgaacactatcccatatcaccagctcaccgtctttcattgccatacggaactccggatgagcattcatcaggcgggcaagaatgtgaataaaggccggataaaacttgtgcttatttttctttacggtctttaaaaaggccgtaatatccagctgaacggtctggttataggtacattgagtaactgactgaaatgcctcaaaatgttctttacgatgccattgggatatatcaacggtggtatatccagtgatttttttctccattttagcttccttagctcctgaaaatctcgataactcaaaaaatacgcccggtagtgatcttatttcattatggtgaaagttggaacctcttacgtgccaagccaaataggccgt

SEQ ID NO: 76 - DNA, 6909 bp, Artificial Sequence
  Synthetic Polynucleotide
cactcggtcgctacgctccgggcgtgagactgcggcgggcgctgcggacacatacaaagttacccacagattccgtggataagcaggggactaacatgtgaggcaaaacagcagggccgcgccggtggcgtttttccataggctccgccctcctgccagagttcacataaacagacgcttttccggtgcatctgtgggagccgtgaggctcaaccatgaatctgacagtacgggcgaaacccgacaggacttaaagatccccaccgtttccggcgggtcgctccctcttgcgctctcctgttccgaccctgccgtttaccggatacctgttccgcctttctcccttacgggaagtgtggcgctttctcatagctcacacactggtatctcggctcggtgtaggtcgttcgctccaagctgggctgtaagcaagaactccccgttcagcccgactgctgcgccttatccggtaactgttcacttgagtccaacccggaaaagcacggtaaaacgccactggcagcagccattggtaactgggagttcgcagaggatttgtttagctaaacacgcggttgctcttgaagtgtgcgccaaagtccggctacactggaaggacagatttggttgctgtgctctgcgaaagccagttaccacggttaagcagttccccaactgacttaaccttcgatcaaaccacctccccaggtggttttttcgtttacagggcaaaagattacgcgcagaaaaaaaggatctcaagaagatcctttgatcttttctactgaaccgctctagatttcagtgcaatttatctcttcaaatgtagcacctgaagtcagcccaggaggaagaggacatccggtcaaataaaacgaaaggctcagtcgaaagactgggcctttcgttttagacttagggaccctttatgacaacttgacggctacatcattcactttttcttcacaaccggcacggaactcgctcgggctggccccggtgcattttttaaatacccgcgagaaatagagttgatcgtcaaaaccaacattgcgaccgacggtggcgataggcatccgggtggtgctcaaaagcagcttcgcctggctgatacgttggtcctcgcgccagcttaagacgctaatccctaactgctggcggaaaagatgtgacagacgcgacggcgacaagcaaacatgctgtgcgacgctggcgatatcaaaattgctgtctgccaggtgatcgctgatgtactgacaagcctcgcgtacccgattatccatcggtggatggagcgactcgttaatcgcttccatgcgccgcagtaacaattgctcaagcagatttatcgccagcagctccgaatagcgcccttccccttgcccggcgttaatgatttgcccaaacaggtcgctgaaatgcggctggtgcgcttcatccgggcgaaagaaccccgtattggcaaatattgacggccagttaagccattcatgccagtaggcgcgcggacgaaagtaaacccactggtgataccattcgcgagcctccggatgacgaccgtagtgatgaatctctcctggcgggaacagcaaaatatcacccggtcggcaaacaaattctcgtccctgatttttcaccaccccctgaccgcgaatggtgagattgagaatataacctttcattcccagcggtcggtcgataaaaaaatcgagataaccgttggcctcaatcggcgttaaacccgccaccagatgggcattaaacgagtatcccggcagcaggggatcattttgcgcttcagccatacttttcatactcccaccattcagagaagaaaccaattgtccatattgcatcagacattgccgtcactgcgtcttttactggctcttctcgctaacccaaccggtaaccccgcttattaaaagcattctgtaacaaagcgggaccaaagccatgacaaaaacgcgtaacaaaagtgtctataatcacggcagaaaagtccacattgattatttgcacggcgtcacactttgctatgccatagcatttttatccataagattagcggatcctacctgacgctttttatcgcaactctctactgtttctccatacccgtttttttggacgcgtacaactcaagtctgacataaatgaccgctatgagcactgcaattacacgccagatcgttctcgctaccgcaaccaccggtatgaaccagattggtgcgcactatgaaggccacaagatcattgagattggtgccgttgaagtggtgaaccgtcgcctgacgggcaataacttccatgtttatctcaaacccgatcggctggtggatccggaagcctttggcgtacatggtattgccgatgaatttttgctcgataagcccacgtttgccgaagtagccgatgagttcatggactatattcgcggcgcggagttggtgatccataacgcagcgttcgatatcggctttatggactacgagttttcgttgcttaagcgcgatattccgaagaccaatactttctgtaaggtcaccgatagccttgcggtggcgaggaaaatgtttcccggtaagcgcaacagcctcgatgcgttatgtgctcgctacgaaatagataacagtaaacgaacgctgcacggggcattactcgatgcccagatccttgcggaagtttatctggcgatgaccggtggtcaaacgtcgatggcttttgcgatggaaggagagacacaacagcaacaaggtgaagcaacaattcagcgcattgtacgtcaggcaagtaagttacgcgttgtttttgcgacagatgaagagattgcagctcatgaagcccgtctcgatctggtgcagaagaaaggcggaagttgcctctggcgagcataatttaatatcagtaaaccggacataacccatgaagaaaaatcgcgcttttttgaagtgggcagggggcaagtatcccctgcttgatgatattaaacggcatttgcccaagggcgaatgtctggttgagccttttgtaggtgccgggtcggtgtttctcaacaccgacttttctcgttatatccttgccgatatcaatagcgacctgatcagtctctataacattgtgaagatgcgtactgatgagtacgtacaggccgcacgcgagctgtttgttcccgaaacaaattgcgccgaggtttactatcagttccgcgaagagttcaacaaaagccaggatccgttccgtcgggcggtactgtttttatatttgaaccgctacggttacaacggcctgtgtcgttacaatctgcgcggtgagtttaacgtgccgttcggccgctacaaaaaaccctatttcccggaagcagagttgtatcacttcgctgaaaaagcgcagaatgcctttttctattgtgagtcttacgccgatagcatggcgcgcgcagatgatgcatccgtcgtctattgcgatccgccttatgcaccgctgtctgcgaccgccaactttacggcgtatcacacaaacagttttacgcttgaacaacaagcgcatctggcggagatcgccgaaggtctggttgagcgccatattccagtgctgatctccaatcacgatacgatgttaacgcgtgagtggtatcagcgcgcaaaattgcatgtcgtcaaagttcgacgcagtataagcagcaacggcggcacacgtaaaaaggtggacgaactgctggctttgtacaaaccaggagtcgtttcacccgcgaaaaaataatttaatatcagggaaccggacataaccccatgccggcgaccagcaaaggtccggttgagcgcaaagttgtgcgtatcgttacgccaggcaccatcagcgatgaagccctgttgcaggagcgtcaggacaacctgctggcggctatctggcaggacagcaaaggtttcggctacgcgacgctggatatcagttccgggcgttttcgcctgagcgaaccggctgaccgcgaaacgatggcggcagaactgcaacgcactaatcctgcggaactgctgtatgcagaagattttgctgaaatgtcgttaattgaaggccgtcgcggcctgcgccgtcgcccgctgtgggagtttgaaatcgacaccgcgcgccagcagttgaatctgcaatttgggacccgcgatctggtcggttttggcgtcgagaacgcgccgcgcggactttgtgctgccggttgtctgttgcagtatgcgaaagatacccaacgtacgactctgccgcatattcgttccatcaccatggaacgtgagcaggacagcatcattatggatgccgcgacgcgtcgtaatctggaaatcacccagaacctggcgggtggtgcggaaaatacgctggcttctgtgctcgactgcaccgtcacgccgatgggcagccgtatgctgaaacgctggctgcatatgccagtgcgcgatacccgcgtgttgcttgagcgccagcaaactattggcgcattgcaggatttcaccgccgggctacagccggtactgcgtcaggtcggcgacctggaacgtattctggcacgtctggctttacgaactgctcgcccacgcgatctggcccgtatgcgccacgctttccagcaactgccggagctgcgtgcgcagttagaaactgtcgatagtgcaccggtacaggcgctacgtgagaagatgggcgagtttgccgagctgcgcgatctgctggagcgagcaatcatcgacacaccgccggtgctggtacgcgacggtggtgttatcgcatcgggctataacgaagagctggatgagtggcgcgcgctggctgacggcgcgaccgattatctggagcgtctggaagtccgcgagcgtgaacgtaccggcctggacacgctgaaagttggctttaatgcggtgcacggctactacattcaaatcagccgtgggcaaagccatctggcacccatcaactacatgcgtcgccagacgctgaaaaacgccgagcgctacatcattccagagctaaaagagtacgaagataaagttctcacctcaaaaggcaaagcactggcactggaaaaacagctttatgaagagctgttcgacctgctgttgccgcatctggaagcgttgcaacagagcgcgagcgcgctggcggaactcgacgtgctggttaacctggcggaacgggcctataccctgaactacacctgcccgaccttcattgataaaccgggcattcgcattaccgaaggtcgccatccggtagttgaacaagtactgaatgagccatttatcgccaacccgctgaatctgtcgccgcagcgccgcatgttgatcatcaccggtccgaacatgggcggtaaaagtacctatatgcgccagaccgcactgattgcgctgatggcctacatcggcagctatgtaccggcacaaaaagtcgagattggacctatcgatcgcatctttacccgcgtaggcgcggcagatgacctggcgtccgggcgctcaacctttatggtggagatgactgaaaccgccaatattttacataacgccaccgaatacagtctggtgttaatggatgagatcgggcgtggaacgtccacctacgatggtctgtcgctggcgtgggcgtgcgcggaaaatctggcgaataagattaaggcattgacgttatttgctacccactatttcgagctgacccagttaccggagaaaatggaaggcgtcgctaacgtgcatctcgatgcactggagcacggcgacaccattgcctttatgcacagcgtgcaggatggcgcggcgagcaaaagctacggcctggcggttgcagctctggcaggcgtgccaaaagaggttattaagcgcgcacggcaaaagctgcgtgagctggaaagcatttcgccgaacgccgccgctacgcaagtggatggtacgcaaatgtctttgctgtcagtaccagaagaaacttcgcctgcggtcgaagctctggaaaatcttgatccggattcactcaccccgcgtcaggcgctggagtggatttatcgcttgaagagcctggtgtaaacttaattaacggcactcctcagccaagtcaaaagcctccgaccggaggcttttgactacatgcccatggcgtttacgccccgccctgccactcatcgcagtactgttgtaattcattaagcattctgccgacatggaagccatcacaaacggcatgatgaacctgaatcgccagcggcatcagcaccttgtcgccttgcgtataatatttgcccatagtgaaaacgggggcgaagaagttgtccatattggccacgtttaaatcaaaactggtgaaactcacccagggattggctgagacgaaaaacatattctcaataaaccctttagggaaataggccaggttttcaccgtaacacgccacatcttgcgaatatatgtgtagaaactgccggaaatcgtcgtggtattcactccagagcgatgaaaacgtttcagtttgctcatggaaaacggtgtaacaagggtgaacactatcccatatcaccagctcaccgtctttcattgccatacggaactccggatgagcattcatcaggcgggcaagaatgtgaataaaggccggataaaacttgtgcttatttttctttacggtctttaaaaaggccgtaatatccagctgaacggtctggttataggtacattgagcaactgactgaaatgcctcaaaatgttctttacgatgccattgggatatatcaacggtggtatatccagtgatttttttctccattttagcttccttagctcctgaaaatctcgataactcaaaaaatacgcccggtagtgatcttatttcattatggtgaaagttggaacctcttacgtgccaagccaaataggccgt

SEQ ID NO: 77 - DNA, 5364 bp, Artificial Sequence
  Synthetic Polynucleotide
cactcggtcgctacgctccgggcgtgagactgcggcgggcgctgcggacacatacaaagttacccacagattccgtggataagcaggggactaacatgtgaggcaaaacagcagggccgcgccggtggcgtttttccataggctccgccctcctgccagagttcacataaacagacgcttttccggtgcatctgtgggagccgtgaggctcaaccatgaatctgacagtacgggcgaaacccgacaggacttaaagatccccaccgtttccggcgggtcgctccctcttgcgctctcctgttccgaccctgccgtttaccggatacctgttccgcctttctcccttacgggaagtgtggcgctttctcatagctcacacactggtatctcggctcggtgtaggtcgttcgctccaagctgggctgtaagcaagaactccccgttcagcccgactgctgcgccttatccggtaactgttcacttgagtccaacccggaaaagcacggtaaaacgccactggcagcagccattggtaactgggagttcgcagaggatttgtttagctaaacacgcggttgctcttgaagtgtgcgccaaagtccggctacactggaaggacagatttggttgctgtgctctgcgaaagccagttaccacggttaagcagttccccaactgacttaaccttcgatcaaaccacctccccaggtggttttttcgtttacagggcaaaagattacgcgcagaaaaaaaggatctcaagaagatcctttgatcttttctactgaaccgctctagatttcagtgcaatttatctcttcaaatgtagcacctgaagtcagcccaggaggaagaggacatccggtcaaataaaacgaaaggctcagtcgaaagactgggcctttcgttttagacttagggaccctttatgacaacttgacggctacatcattcactttttcttcacaaccggcacggaactcgctcgggctggccccggtgcattttttaaatacccgcgagaaatagagttgatcgtcaaaaccaacattgcgaccgacggtggcgataggcatccgggtggtgctcaaaagcagcttcgcctggctgatacgttggtcctcgcgccagcttaagacgctaatccctaactgctggcggaaaagatgtgacagacgcgacggcgacaagcaaacatgctgtgcgacgctggcgatatcaaaattgctgtctgccaggtgatcgctgatgtactgacaagcctcgcgtacccgattatccatcggtggatggagcgactcgttaatcgcttccatgcgccgcagtaacaattgctcaagcagatttatcgccagcagctccgaatagcgcccttccccttgcccggcgttaatgatttgcccaaacaggtcgctgaaatgcggctggtgcgcttcatccgggcgaaagaaccccgtattggcaaatattgacggccagttaagccattcatgccagtaggcgcgcggacgaaagtaaacccactggtgataccattcgcgagcctccggatgacgaccgtagtgatgaatctctcctggcgggaacagcaaaatatcacccggtcggcaaacaaattctcgtccctgatttttcaccaccccctgaccgcgaatggtgagattgagaatataacctttcattcccagcggtcggtcgataaaaaaatcgagataaccgttggcctcaatcggcgttaaacccgccaccagatgggcattaaacgagtatcccggcagcaggggatcattttgcgcttcagccatacttttcatactcccaccattcagagaagaaaccaattgtccatattgcatcagacattgccgtcactgcgtcttttactggctcttctcgctaacccaaccggtaaccccgcttattaaaagcattctgtaacaaagcgggaccaaagccatgacaaaaacgcgtaacaaaagtgtctataatcacggcagaaaagtccacattgattatttgcacggcgtcacactttgctatgccatagcatttttatccataagattagcggatcctacctgacgctttttatcgcaactctctactgtttctccatacccgtttttttggacgcgtacaactcaagtctgacataaatgaccgctatggcgcaggcaggttttatcttaacccgacactggcgggacaccccgcaagggacagaagtctccttctggctggcgacggacaacgggccgttgcaggttacgcttgcaccgcaagagtccgtggcgtttattcccgccgatcaggttccccgcgctcagcatattttgcagggtgaacaaggcgttcgcctgacaccgctggcgttaaaggattttcaccgccagccggtgtatggcctttactgtcgcgcccatcgccaattgatgaattacgaaaagcgcctgcgtgaaggtggcgttaccgtctacgaggccgatgtgcgcccgccagaacgctatctgatggagcggtttatcacctcaccggtgtgggtcgagggtgatatgcacaatggcgctatcgttaatgcccgtctgaaaccgcatcccgactatcgtccgccgctcaagtgggtttctattgatattgaaaccacccgccacggtgagctgtactgcatcggcctggaaggctgcgggcagcgcatcgtttatatgctggggccagagaatggcgacgcctccgcgctcgattttgaactggaatacgtcgccagccgcccgcagctactggaaaaactcaacgcctggtttgccaactacgatcctgatgtgatcatcggttggaacgtggtgcagttcgatctgcgaatgctgcaaaaacatgccgagcgttaccgtattccgctgcggctggggcgcgataacagtgagctggagtggcgcgagcacggctttaaaaacggcgtcttttttgcccaggctaaaggtcggctaattatcgacggtatcgaggcgctgaaatccgcgttctggaatttctcttcattctcgctggaaaccgtcgctcaggagttattaggcgaaggaaaatctatcgataacccgtgggatcgaatggacgaaattgaccgccgtttcgccgaagataaacctgcgctggcgacttataacctgaaagattgcgagctggtgacgcagattttccataaaactgaaatcatgccatttttactcgaacgagcgacggtgaacggcctgccggtagaccgccacgggggatcggtggcggcgtttggtcatctctattttcctcgtatgcaccgcgctggttatgtcgcgcctaatctcggcgaagtgccgccacacgccagccctggcggctacgtgatggattcacggccagggctttatgattcggtactggtgctggactataaaagcctgtacccgtcgatcatccgcacctttctgattgatcccgtcgggctggtggaaggcatggcgcagcctgatccagagcacagtaccgaaggttttctcgatgcctggttctcgcgagaaaaacattgcctgccggagattgtgactaacatctggcacgggcgcgatgaagccaaacgccagggtaacaaaccgctgtcgcaggcgctgaaaatcatcatgaatgccttttatggcgtgctcggcaccaccgcctgccgcttcttcgatccgcggctggcatcgtcgatcaccatgcgtggtcatcagatcatgcggcaaaccaaagcgttgattgaagcacagggctacgacgttatctacggcgataccgactcaacgtttgtctggctgaaaggcgcacattcggaagaagaagcggcgaaaatcggtcgtgcactggtgcagcacgttaacgcctggtgggcggaaacgctgcaaaaacaacggctgaccagcgcattagaactggagtatgaaacccatttctgccgttttctgatgccaaccattcgcggagccgataccggcagtaaaaagcgttatgccggactgattcaggagggcgacaagcagcggatggtgtttaaagggctggaaaccgtgcgcaccgactggacgccgctggcccagcagtttcagcaggagctatacctgcgcatcttccgcaacgagccatatcaggaatatgtacgcgaaaccatcgacaaactgatggcgggtgaactggatgcgcgactggtttaccgtaaacgccttcgccgtccgctgagcgagtatcagcgtaatgtgccgcctcatgtacgcgccgctcgccttgccgatgaagaaaaccaaaagcgtggtcgccccttgcaatatcagaatcgcggcaccattaagtacgtatggaccaccaacggcccggagccgctggactaccaacgttcaccactggattacgaacactatctgacccgccagctacaacccgtggcggagggaatactcccttttattgaggataattttgctacacttatgaccgggcaacttgggctattttaaacttaattaacggcactcctcagccaagtcaaaagcctccgaccggaggcttttgactacatgcccatggcgtttacgccccgccctgccactcatcgcagtactgttgtaattcattaagcattctgccgacatggaagccatcacaaacggcatgatgaacctgaatcgccagcggcatcagcaccttgtcgccttgcgtataatatttgcccatagtgaaaacgggggcgaagaagttgtccatattggccacgtttaaatcaaaactggtgaaactcacccagggattggctgagacgaaaaacatattctcaataaaccctttagggaaataggccaggttttcaccgtaacacgccacatcttgcgaatatatgtgtagaaactgccggaaatcgtcgtggtattcactccagagcgatgaaaacgtttcagtttgctcatggaaaacggtgtaacaagggtgaacactatcccatatcaccagctcaccgtctttcattgccatacggaactccggatgagcattcatcaggcgggcaagaatgtgaataaaggccggataaaacttgtgcttatttttctttacggtctttaaaaaggccgtaatatccagctgaacggtctggttataggtacattgagtaactgactgaaatgcctcaaaatgttctttacgatgccattgggatatatcaacggtggtatatccagtgatttttttctccattttagcttccttagctcctgaaaatctcgataactcaaaaaatacgcccggtagtgatcttatttcattatggtgaaagttggaacctcttacgtgccaagccaaataggccgt

SEQ ID NO: 78 - DNA, 5364 bp, Artificial Sequence
  Synthetic Polynucleotide
cactcggtcgctacgctccgggcgtgagactgcggcgggcgctgcggacacatacaaagttacccacagattccgtggataagcaggggactaacatgtgaggcaaaacagcagggccgcgccggtggcgtttttccataggctccgccctcctgccagagttcacataaacagacgcttttccggtgcatctgtgggagccgtgaggctcaaccatgaatctgacagtacgggcgaaacccgacaggacttaaagatccccaccgtttccggcgggtcgctccctcttgcgctctcctgttccgaccctgccgtttaccggatacctgttccgcctttctcccttacgggaagtgtggcgctttctcatagctcacacactggtatctcggctcggtgtaggtcgttcgctccaagctgggctgtaagcaagaactccccgttcagcccgactgctgcgccttatccggtaactgttcacttgagtccaacccggaaaagcacggtaaaacgccactggcagcagccattggtaactgggagttcgcagaggatttgtttagctaaacacgcggttgctcttgaagtgtgcgccaaagtccggctacactggaaggacagatttggttgctgtgctctgcgaaagccagttaccacggttaagcagttccccaactgacttaaccttcgatcaaaccacctccccaggtggttttttcgtttacagggcaaaagattacgcgcagaaaaaaaggatctcaagaagatcctttgatcttttctactgaaccgctctagatttcagtgcaatttatctcttcaaatgtagcacctgaagtcagcccaggaggaagaggacatccggtcaaataaaacgaaaggctcagtcgaaagactgggcctttcgttttagacttagggaccctttatgacaacttgacggctacatcattcactttttcttcacaaccggcacggaactcgctcgggctggccccggtgcattttttaaatacccgcgagaaatagagttgatcgtcaaaaccaacattgcgaccgacggtggcgataggcatccgggtggtgctcaaaagcagcttcgcctggctgatacgttggtcctcgcgccagcttaagacgctaatccctaactgctggcggaaaagatgtgacagacgcgacggcgacaagcaaacatgctgtgcgacgctggcgatatcaaaattgctgtctgccaggtgatcgctgatgtactgacaagcctcgcgtacccgattatccatcggtggatggagcgactcgttaatcgcttccatgcgccgcagtaacaattgctcaagcagatttatcgccagcagctccgaatagcgcccttccccttgcccggcgttaatgatttgcccaaacaggtcgctgaaatgcggctggtgcgcttcatccgggcgaaagaaccccgtattggcaaatattgacggccagttaagccattcatgccagtaggcgcgcggacgaaagtaaacccactggtgataccattcgcgagcctccggatgacgaccgtagtgatgaatctctcctggcgggaacagcaaaatatcacccggtcggcaaacaaattctcgtccctgatttttcaccaccccctgaccgcgaatggtgagattgagaatataacctttcattcccagcggtcggtcgataaaaaaatcgagataaccgttggcctcaatcggcgttaaacccgccaccagatgggcattaaacgagtatcccggcagcaggggatcattttgcgcttcagccatacttttcatactcccaccattcagagaagaaaccaattgtccatattgcatcagacattgccgtcactgcgtcttttactggctcttctcgctaacccaaccggtaaccccgcttattaaaagcattctgtaacaaagcgggaccaaagccatgacaaaaacgcgtaacaaaagtgtctataatcacggcagaaaagtccacattgattatttgcacggcgtcacactttgctatgccatagcatttttatccataagattagcggatcctacctgacgctttttatcgcaactctctactgtttctccatacccgtttttttggacgcgtacaactcaagtctgacataaatgaccgctatggcgcaggcaggttttatcttaacccgacactggcgggacaccccgcaagggacagaagtctccttctggctggcgacggacaacgggccgttgcaggttacgcttgcaccgcaagagtccgtggcgtttattcccgccgatcaggttccccgcgctcagcatattttgcagggtgaacaaggcgttcgcctgacaccgctggcgttaaaggattttcaccgccagccggtgtatggcctttactgtcgcgcccatcgccaattgatgaattacgaaaagcgcctgcgtgaaggtggcgttaccgtctacgaggccgatgtgcgcccgccagaacgctatctgatggagcggtttatcacctcaccggtgtgggtcgagggtgatatgcacaatggcgctatcgttaatgcccgtctgaaaccgcatcccgactatcgtccgccgctcaagtgggtttctattgcgattgaaaccacccgccacggtgagctgtactgcatcggcctggaaggctgcgggcagcgcatcgtttatatgctggggccagagaatggcgacgcctccgcgctcgattttgaactggaatacgtcgccagccgcccgcagctactggaaaaactcaacgcctggtttgccaactacgatcctgatgtgatcatcggttggaacgtggtgcagttcgatctgcgaatgctgcaaaaacatgccgagcgttaccgtattccgctgcggctggggcgcgataacagtgagctggagtggcgcgagcacggctttaaaaacggcgtcttttttgcccaggctaaaggtcggctaattatcgacggtatcgaggcgctgaaatccgcgttctggaatttctcttcattctcgctggaaaccgtcgctcaggagttattaggcgaaggaaaatctatcgataacccgtgggatcgaatggacgaaattgaccgccgtttcgccgaagataaacctgcgctggcgacttataacctgaaagattgcgagctggtgacgcagattttccataaaactgaaatcatgccatttttactcgaacgagcgacggtgaacggcctgccggtagaccgccacgggggatcggtggcggcgtttggtcatctctattttcctcgtatgcaccgcgctggttatgtcgcgcctaatctcggcgaagtgccgccacacgccagccctggcggctacgtgatggattcacggccagggctttatgattcggtactggtgctggactataaaagcctgtacccgtcgatcatccgcacctttctgattgatcccgtcgggctggtggaaggcatggcgcagcctgatccagagcacagtaccgaaggttttctcgatgcctggttctcgcgagaaaaacattgcctgccggagattgtgactaacatctggcacgggcgcgatgaagccaaacgccagggtaacaaaccgctgtcgcaggcgctgaaaatcatcatgaatgccttttatggcgtgctcggcaccaccgcctgccgcttcttcgatccgcggctggcatcgtcgatcaccatgcgtggtcatcagatcatgcggcaaaccaaagcgttgattgaagcacagggctacgacgttatctacggcgataccgactcaacgtttgtctggctgaaaggcgcacattcggaagaagaagcggcgaaaatcggtcgtgcactggtgcagcacgttaacgcctggtgggcggaaacgctgcaaaaacaacggctgaccagcgcattagaactggagtatgaaacccatttctgccgttttctgatgccaaccattcgcggagccgataccggcagtaaaaagcgttatgccggactgattcaggagggcgacaagcagcggatggtgtttaaagggctggaaaccgtgcgcaccgactggacgccgctggcccagcagtttcagcaggagctatacctgcgcatcttccgcaacgagccatatcaggaatatgtacgcgaaaccatcgacaaactgatggcgggtgaactggatgcgcgactggtttaccgtaaacgccttcgccgtccgctgagcgagtatcagcgtaatgtgccgcctcatgtacgcgccgctcgccttgccgatgaagaaaaccaaaagcgtggtcgccccttgcaatatcagaatcgcggcaccattaagtacgtatggaccaccaacggcccggagccgctggactaccaacgttcaccactggattacgaacactatctgacccgccagctacaacccgtggcggagggaatactcccttttattgaggataattttgctacacttatgaccgggcaacttgggctattttaaacttaattaacggcactcctcagccaagtcaaaagcctccgaccggaggcttttgactacatgcccatggcgtttacgccccgccctgccactcatcgcagtactgttgtaattcattaagcattctgccgacatggaagccatcacaaacggcatgatgaacctgaatcgccagcggcatcagcaccttgtcgccttgcgtataatatttgcccatagtgaaaacgggggcgaagaagttgtccatattggccacgtttaaatcaaaactggtgaaactcacccagggattggctgagacgaaaaacatattctcaataaaccctttagggaaataggccaggttttcaccgtaacacgccacatcttgcgaatatatgtgtagaaactgccggaaatcgtcgtggtattcactccagagcgatgaaaacgtttcagtttgctcatggaaaacggtgtaacaagggtgaacactatcccatatcaccagctcaccgtctttcattgccatacggaactccggatgagcattcatcaggcgggcaagaatgtgaataaaggccggataaaacttgtgcttatttttctttacggtctttaaaaaggccgtaatatccagctgaacggtctggttataggtacattgagtaactgactgaaatgcctcaaaatgttctttacgatgccattgggatatatcaacggtggtatatccagtgatttttttctccattttagcttccttagctcctgaaaatctcgataactcaaaaaatacgcccggtagtgatcttatttcattatggtgaaagttggaacctcttacgtgccaagccaaataggccgt

SEQ ID NO: 79 - DNA, 6461 bp, Artificial Sequence
  Synthetic Polynucleotide
cactcggtcgctacgctccgggcgtgagactgcggcgggcgctgcggacacatacaaagttacccacagattccgtggataagcaggggactaacatgtgaggcaaaacagcagggccgcgccggtggcgtttttccataggctccgccctcctgccagagttcacataaacagacgcttttccggtgcatctgtgggagccgtgaggctcaaccatgaatctgacagtacgggcgaaacccgacaggacttaaagatccccaccgtttccggcgggtcgctccctcttgcgctctcctgttccgaccctgccgtttaccggatacctgttccgcctttctcccttacgggaagtgtggcgctttctcatagctcacacactggtatctcggctcggtgtaggtcgttcgctccaagctgggctgtaagcaagaactccccgttcagcccgactgctgcgccttatccggtaactgttcacttgagtccaacccggaaaagcacggtaaaacgccactggcagcagccattggtaactgggagttcgcagaggatttgtttagctaaacacgcggttgctcttgaagtgtgcgccaaagtccggctacactggaaggacagatttggttgctgtgctctgcgaaagccagttaccacggttaagcagttccccaactgacttaaccttcgatcaaaccacctccccaggtggttttttcgtttacagggcaaaagattacgcgcagaaaaaaaggatctcaagaagatcctttgatcttttctactgaaccgctctagatttcagtgcaatttatctcttcaaatgtagcacctgaagtcagcccaggaggaagaggacatccggtcaaataaaacgaaaggctcagtcgaaagactgggcctttcgttttagacttagggaccctttatgacaacttgacggctacatcattcactttttcttcacaaccggcacggaactcgctcgggctggccccggtgcattttttaaatacccgcgagaaatagagttgatcgtcaaaaccaacattgcgaccgacggtggcgataggcatccgggtggtgctcaaaagcagcttcgcctggctgatacgttggtcctcgcgccagcttaagacgctaatccctaactgctggcggaaaagatgtgacagacgcgacggcgacaagcaaacatgctgtgcgacgctggcgatatcaaaattgctgtctgccaggtgatcgctgatgtactgacaagcctcgcgtacccgattatccatcggtggatggagcgactcgttaatcgcttccatgcgccgcagtaacaattgctcaagcagatttatcgccagcagctccgaatagcgcccttccccttgcccggcgttaatgatttgcccaaacaggtcgctgaaatgcggctggtgcgcttcatccgggcgaaagaaccccgtattggcaaatattgacggccagttaagccattcatgccagtaggcgcgcggacgaaagtaaacccactggtgataccattcgcgagcctccggatgacgaccgtagtgatgaatctctcctggcgggaacagcaaaatatcacccggtcggcaaacaaattctcgtccctgatttttcaccaccccctgaccgcgaatggtgagattgagaatataacctttcattcccagcggtcggtcgataaaaaaatcgagataaccgttggcctcaatcggcgttaaacccgccaccagatgggcattaaacgagtatcccggcagcaggggatcattttgcgcttcagccatacttttcatactcccaccattcagagaagaaaccaattgtccatattgcatcagacattgccgtcactgcgtcttttactggctcttctcgctaacccaaccggtaaccccgcttattaaaagcattctgtaacaaagcgggaccaaagccatgacaaaaacgcgtaacaaaagtgtctataatcacggcagaaaagtccacattgattatttgcacggcgtcacactttgctatgccatagcatttttatccataagattagcggatcctacctgacgctttttatcgcaactctctactgtttctccatacccgtttttttggacgcgtacaactcaagtctgacataaatgaccgctatgagcactgcaattacacgccagatcgttctcgctaccgcaaccaccggtatgaaccagattggtgcgcactatgaaggccacaagatcattgagattggtgccgttgaagtggtgaaccgtcgcctgacgggcaataacttccatgtttatctcaaacccgatcggctggtggatccggaagcctttggcgtacatggtattgccgatgaatttttgctcgataagcccacgtttgccgaagtagccgatgagttcatggactatattcgcggcgcggagttggtgatccataacgcagcgttcgatatcggctttatggactacgagttttcgttgcttaagcgcgatattccgaagaccaatactttctgtaaggtcaccgatagccttgcggtggcgaggaaaatgtttcccggtaagcgcaacagcctcgatgcgttatgtgctcgctacgaaatagataacagtaaacgaacgctgcacggggcattactcgatgcccagatccttgcggaagtttatctggcgatgaccggtggtcaaacgtcgatggcttttgcgatggaaggagagacacaacagcaacaaggtgaagcaacaattcagcgcattgtacgtcaggcaagtaagttacgcgttgtttttgcgacagatgaagagattgcagctcatgaagcccgtctcgatctggtgcagaagaaaggcggaagttgcctctggcgagcataatttaatatcagtaaaccggacataacccatgaagaaaaatcgcgcttttttgaagtgggcagggggcaagtatcccctgcttgatgatattaaacggcatttgcccaagggcgaatgtctggttgagccttttgtaggtgccgggtcggtgtttctcaacaccgacttttctcgttatatccttgccgatatcaatagcgacctgatcagtctctataacattgtgaagatgcgtactgatgagtacgtacaggccgcacgcgagctgtttgttcccgaaacaaattgcgccgaggtttactatcagttccgcgaagagttcaacaaaagccaggatccgttccgtcgggcggtactgtttttatatttgaaccgctacggttacaacggcctgtgtcgttacaatctgcgcggtgagtttaacgtgccgttcggccgctacaaaaaaccctatttcccggaagcagagttgtatcacttcgctgaaaaagcgcagaatgcctttttctattgtgagtcttacgccgatagcatggcgcgcgcagatgatgcatccgtcgtctattgcgatccgccttatgcaccgctgtctgcgaccgccaactttacggcgtatcacacaaacagttttacgcttgaacaacaagcgcatctggcggagatcgccgaaggtctggttgagcgccatattccagtgctgatctccaatcacgatacgatgttaacgcgtgagtggtatcagcgcgcaaaattgcatgtcgtcaaagttcgacgcagtataagcagcaacggcggcacacgtaaaaaggtggacgaactgctggctttgtacaaaccaggagtcgtttcacccgcgaaaaaataattcagctaagacactgcactggattaagatgaaaacgattgaagttgatgatgaactctacagctatattgccagccacactaagcatatcggcgagagcgcatccgacattttacggcgtatgttgaaattttccgccgcatcacagcctgctgctccggtgacgaaagaggttcgcgttgcgtcacctgctatcgtcgaagcgaagccggtcaaaacgattaaagacaaggttcgcgcaatgcgtgaacttctgctttcggatgaatacgcagagcaaaagcgagcggtcaatcgctttatgctgctgttgtctacactatattctcttgacgcccaggcgtttgccgaagcaacggaatcgttgcacggtcgtacacgcgtttactttgcggcagatgaacaaacgctgctgaaaaatggtaatcagaccaagccgaaacatgtgccaggcacgccgtattgggtgatcaccaacaccaacaccggccgtaaatgcagcatgatcgaacacatcatgcagtcgatgcaattcccggcggaattgattgagaaggtttgcggaactatctaacggctgaaattaatgaggtcatacccaaatggatagttcgtttacgcccattgaacaaatgctaaaatttcgcgccagccgccacgaagattttccttatcaggagatccttctgactcgtctttgcatgcacatgcaaagcaagctgctggagaaccgcaataaaatgctgaaggctcagggaattaacgagacgttgtttatggcgttgattacgctggagtctcaggaaaaccacagtattcagccttctgaattaagttgtgctcttggatcatcccgtaccaacgcgacgcgtattgccgatgaactggaaaaacgcggttggatcgaacgtcgtgaaagcgataacgatcgccgctgcctgcatctgcaattaacggaaaaaggtcacgagtttttgcgcgaggttttaccaccgcagcataactgcctgcatcaactctggtccgcgctcagcacaacagaaaaagatcagctcgagcaaatcacccgcaaattgctctcccgtctcgaccagatggaacaagacggtgtggttctcgaagcgatgagctaatgtttgttttttaatcaaggtatcatgacatgtcccaacctcgcccactgctctctcctcccgaaactgaagaacagttgttagcgcaagcacagcaactttctggttatacattgggagaactggcggcacttgtcgggctggttacgccagagaatttaaaacgcgataaaggctggattggcgtgttactggcgatctggctaggtgccagcgcagggagtaaacctgagcaagattttgctgctctgggcgtggaacttaaaactatccctgtggatagtcttggtcgtccgctggaaacaacattcgtttgtgttgccccgttaacgggcaatagcggggtgacctgggaaaccagccacgtgcgccacaaactcaaacgcgtactgtggataccggttgaaggcgagcgcagcatcccgctggcgcagcgtcgcgttggatcaccgttgctgtggagcccgaatgaagaggaagaccggcagctacgcgaagactgggaagaattaatggatatgattgttctcggtcaggttgagcggattaccgctcgtcacggggagtatttacagatacgaccgaaagcagcgaatgcgaaagcgcttaccgaagccattggtgcccggggcgaacggattctgacgctgccacgcggcttttatttgaagaagaatttcaccagtgcactactggcccgtcattttctgatccagtagacttaattaacggcactcctcagccaagtcaaaagcctccgaccggaggcttttgactacatgcccatggcgtttacgccccgccctgccactcatcgcagtactgttgtaattcattaagcattctgccgacatggaagccatcacaaacggcatgatgaacctgaatcgccagcggcatcagcaccttgtcgccttgcgtataatatttgcccatagtgaaaacgggggcgaagaagttgtccatattggccacgtttaaatcaaaactggtgaaactcacccagggattggctgagacgaaaaacatattctcaataaaccctttagggaaataggccaggttttcaccgtaacacgccacatcttgcgaatatatgtgtagaaactgccggaaatcgtcgtggtattcactccagagcgatgaaaacgtttcagtttgctcatggaaaacggtgtaacaagggtgaacactatcccatatcaccagctcaccgtctttcattgccatacggaactccggatgagcattcatcaggcgggcaagaatgtgaataaaggccggataaaacttgtgcttatttttctttacggtctttaaaaaggccgtaatatccagctgaacggtctggttataggtacattgagtaactgactgaaatgcctcaaaatgttctttacgatgccattgggatatatcaacggtggtatatccagtgatttttttctccattttagcttccttagctcctgaaaatctcgataactcaaaaaatacgcccggtagtgatcttatttcattatggtgaaagttggaacctcttacgtgccaagccaaataggccgt

SEQ ID NO: 80 - DNA, 8981 bp, Artificial Sequence
  Synthetic Polynucleotide
cactcggtcgctacgctccgggcgtgagactgcggcgggcgctgcggacacatacaaagttacccacagattccgtggataagcaggggactaacatgtgaggcaaaacagcagggccgcgccggtggcgtttttccataggctccgccctcctgccagagttcacataaacagacgcttttccggtgcatctgtgggagccgtgaggctcaaccatgaatctgacagtacgggcgaaacccgacaggacttaaagatccccaccgtttccggcgggtcgctccctcttgcgctctcctgttccgaccctgccgtttaccggatacctgttccgcctttctcccttacgggaagtgtggcgctttctcatagctcacacactggtatctcggctcggtgtaggtcgttcgctccaagctgggctgtaagcaagaactccccgttcagcccgactgctgcgccttatccggtaactgttcacttgagtccaacccggaaaagcacggtaaaacgccactggcagcagccattggtaactgggagttcgcagaggatttgtttagctaaacacgcggttgctcttgaagtgtgcgccaaagtccggctacactggaaggacagatttggttgctgtgctctgcgaaagccagttaccacggttaagcagttccccaactgacttaaccttcgatcaaaccacctccccaggtggttttttcgtttacagggcaaaagattacgcgcagaaaaaaaggatctcaagaagatcctttgatcttttctactgaaccgctctagatttcagtgcaatttatctcttcaaatgtagcacctgaagtcagcccaggaggaagaggacatccggtcaaataaaacgaaaggctcagtcgaaagactgggcctttcgttttagacttagggaccctttatgacaacttgacggctacatcattcactttttcttcacaaccggcacggaactcgctcgggctggccccggtgcattttttaaatacccgcgagaaatagagttgatcgtcaaaaccaacattgcgaccgacggtggcgataggcatccgggtggtgctcaaaagcagcttcgcctggctgatacgttggtcctcgcgccagcttaagacgctaatccctaactgctggcggaaaagatgtgacagacgcgacggcgacaagcaaacatgctgtgcgacgctggcgatatcaaaattgctgtctgccaggtgatcgctgatgtactgacaagcctcgcgtacccgattatccatcggtggatggagcgactcgttaatcgcttccatgcgccgcagtaacaattgctcaagcagatttatcgccagcagctccgaatagcgcccttccccttgcccggcgttaatgatttgcccaaacaggtcgctgaaatgcggctggtgcgcttcatccgggcgaaagaaccccgtattggcaaatattgacggccagttaagccattcatgccagtaggcgcgcggacgaaagtaaacccactggtgataccattcgcgagcctccggatgacgaccgtagtgatgaatctctcctggcgggaacagcaaaatatcacccggtcggcaaacaaattctcgtccctgatttttcaccaccccctgaccgcgaatggtgagattgagaatataacctttcattcccagcggtcggtcgataaaaaaatcgagataaccgttggcctcaatcggcgttaaacccgccaccagatgggcattaaacgagtatcccggcagcaggggatcattttgcgcttcagccatacttttcatactcccaccattcagagaagaaaccaattgtccatattgcatcagacattgccgtcactgcgtcttttactggctcttctcgctaacccaaccggtaaccccgcttattaaaagcattctgtaacaaagcgggaccaaagccatgacaaaaacgcgtaacaaaagtgtctataatcacggcagaaaagtccacattgattatttgcacggcgtcacactttgctatgccatagcatttttatccataagattagcggatcctacctgacgctttttatcgcaactctctactgtttctccatacccgtttttttggacgcgtacaactcaagtctgacataaatgaccgctatgagcactgcaattacacgccagatcgttctcgctaccgcaaccaccggtatgaaccagattggtgcgcactatgaaggccacaagatcattgagattggtgccgttgaagtggtgaaccgtcgcctgacgggcaataacttccatgtttatctcaaacccgatcggctggtggatccggaagcctttggcgtacatggtattgccgatgaatttttgctcgataagcccacgtttgccgaagtagccgatgagttcatggactatattcgcggcgcggagttggtgatccataacgcagcgttcgatatcggctttatggactacgagttttcgttgcttaagcgcgatattccgaagaccaatactttctgtaaggtcaccgatagccttgcggtggcgaggaaaatgtttcccggtaagcgcaacagcctcgatgcgttatgtgctcgctacgaaatagataacagtaaacgaacgctgcacggggcattactcgatgcccagatccttgcggaagtttatctggcgatgaccggtggtcaaacgtcgatggcttttgcgatggaaggagagacacaacagcaacaaggtgaagcaacaattcagcgcattgtacgtcaggcaagtaagttacgcgttgtttttgcgacagatgaagagattgcagctcatgaagcccgtctcgatctggtgcagaagaaaggcggaagttgcctctggcgagcataatttaatatcagtaaaccggacataacccatgaagaaaaatcgcgcttttttgaagtgggcagggggcaagtatcccctgcttgatgatattaaacggcatttgcccaagggcgaatgtctggttgagccttttgtaggtgccgggtcggtgtttctcaacaccgacttttctcgttatatccttgccgatatcaatagcgacctgatcagtctctataacattgtgaagatgcgtactgatgagtacgtacaggccgcacgcgagctgtttgttcccgaaacaaattgcgccgaggtttactatcagttccgcgaagagttcaacaaaagccaggatccgttccgtcgggcggtactgtttttatatttgaaccgctacggttacaacggcctgtgtcgttacaatctgcgcggtgagtttaacgtgccgttcggccgctacaaaaaaccctatttcccggaagcagagttgtatcacttcgctgaaaaagcgcagaatgcctttttctattgtgagtcttacgccgatagcatggcgcgcgcagatgatgcatccgtcgtctattgcgatccgccttatgcaccgctgtctgcgaccgccaactttacggcgtatcacacaaacagttttacgcttgaacaacaagcgcatctggcggagatcgccgaaggtctggttgagcgccatattccagtgctgatctccaatcacgatacgatgttaacgcgtgagtggtatcagcgcgcaaaattgcatgtcgtcaaagttcgacgcagtataagcagcaacggcggcacacgtaaaaaggtggacgaactgctggctttgtacaaaccaggagtcgtttcacccgcgaaaaaataattcagctaagacactgcactggattaagatgaaaacgattgaagttgatgatgaactctacagctatattgccagccacactaagcatatcggcgagagcgcatccgacattttacggcgtatgttgaaattttccgccgcatcacagcctgctgctccggtgacgaaagaggttcgcgttgcgtcacctgctatcgtcgaagcgaagccggtcaaaacgattaaagacaaggttcgcgcaatgcgtgaacttctgctttcggatgaatacgcagagcaaaagcgagcggtcaatcgctttatgctgctgttgtctacactatattctcttgacgcccaggcgtttgccgaagcaacggaatcgttgcacggtcgtacacgcgtttactttgcggcagatgaacaaacgctgctgaaaaatggtaatcagaccaagccgaaacatgtgccaggcacgccgtattgggtgatcaccaacaccaacaccggccgtaaatgcagcatgatcgaacacatcatgcagtcgatgcaattcccggcggaattgattgagaaggtttgcggaactatctaacggctgaaattaatgaggtcatacccaaatggatagttcgtttacgcccattgaacaaatgctaaaatttcgcgccagccgccacgaagattttccttatcaggagatccttctgactcgtctttgcatgcacatgcaaagcaagctgctggagaaccgcaataaaatgctgaaggctcagggaattaacgagacgttgtttatggcgttgattacgctggagtctcaggaaaaccacagtattcagccttctgaattaagttgtgctcttggatcatcccgtaccaacgcgacgcgtattgccgatgaactggaaaaacgcggttggatcgaacgtcgtgaaagcgataacgatcgccgctgcctgcatctgcaattaacggaaaaaggtcacgagtttttgcgcgaggttttaccaccgcagcataactgcctgcatcaactctggtccgcgctcagcacaacagaaaaagatcagctcgagcaaatcacccgcaaattgctctcccgtctcgaccagatggaacaagacggtgtggttctcgaagcgatgagctaataatacaaaaattaggaggaatttcaacatgacaaatttatctgacatcattgaaaaagaaacaggaaaacaactagtgattcaagaatcaattctaatgttaccagaagaagtagaggaagtaattgggaataaaccagaaagtgatattttagttcatactgcttatgatgaaagtacagatgaaaatgtaatgctattaacttcagatgctccagaatataaaccttgggctttagtaattcaagacagtaatggagaaaataaaattaaaatgttataagtcgagattaagtaaaccggaatctgaagatgaccgacgcggaatacgttcgtatccacgaaaaactggacatctacaccttcaaaaaacagttcttcaacaacaaaaaatctgtttctcaccgttgctacgttctgttcgaactgaaacgtcgtggtgaacgtcgtgcgtgcttctggggttacgcggttaacaaaccgcagtctggtaccgaacgtggtatccacgcggaaatcttctctatccgtaaagttgaagaatacctgcgtgacaacccgggtcagttcaccatcaactggtactcttcttggtctccgtgcgcggactgcgcggaaaaaatcctggaatggtacaaccaggaactgcgtggtaacggtcacaccctgaaaatctgggcgtgcaaactgtactacgaaaaaaacgcgcgtaaccagatcggtctgtggaacctgcgtgacaacggtgttggtctgaacgttatggtttctgaacactaccagtgctgccgtaaaatcttcatccagtcttctcacaaccagctgaacgaaaaccgttggctggaaaaaaccctgaaacgtgcggaaaaacgtcgttctgaactgtctatcatgatccaggttaaaatcctgcacaccaccaaatctccggcggtttaatttaatatcagggaaccggacataaccccatgccggcgaccagcaaaggtccggttgagcgcaaagttgtgcgtatcgttacgccaggcaccatcagcgatgaagccctgttgcaggagcgtcaggacaacctgctggcggctatctggcaggacagcaaaggtttcggctacgcgacgctggatatcagttccgggcgttttcgcctgagcgaaccggctgaccgcgaaacgatggcggcagaactgcaacgcactaatcctgcggaactgctgtatgcagaagattttgctgaaatgtcgttaattgaaggccgtcgcggcctgcgccgtcgcccgctgtgggagtttgaaatcgacaccgcgcgccagcagttgaatctgcaatttgggacccgcgatctggtcggttttggcgtcgagaacgcgccgcgcggactttgtgctgccggttgtctgttgcagtatgcgaaagatacccaacgtacgactctgccgcatattcgttccatcaccatggaacgtgagcaggacagcatcattatggatgccgcgacgcgtcgtaatctggaaatcacccagaacctggcgggtggtgcggaaaatacgctggcttctgtgctcgactgcaccgtcacgccgatgggcagccgtatgctgaaacgctggctgcatatgccagtgcgcgatacccgcgtgttgcttgagcgccagcaaactattggcgcattgcaggatttcaccgccgggctacagccggtactgcgtcaggtcggcgacctggaacgtattctggcacgtctggctttacgaactgctcgcccacgcgatctggcccgtatgcgccacgctttccagcaactgccggagctgcgtgcgcagttagaaactgtcgatagtgcaccggtacaggcgctacgtgagaagatgggcgagtttgccgagctgcgcgatctgctggagcgagcaatcatcgacacaccgccggtgctggtacgcgacggtggtgttatcgcatcgggctataacgaagagctggatgagtggcgcgcgctggctgacggcgcgaccgattatctggagcgtctggaagtccgcgagcgtgaacgtaccggcctggacacgctgaaagttggctttaatgcggtgcacggctactacattcaaatcagccgtgggcaaagccatctggcacccatcaactacatgcgtcgccagacgctgaaaaacgccgagcgctacatcattccagagctaaaagagtacgaagataaagttctcacctcaaaaggcaaagcactggcactggaaaaacagctttatgaagagctgttcgacctgctgttgccgcatctggaagcgttgcaacagagcgcgagcgcgctggcggaactcgacgtgctggttaacctggcggaacgggcctataccctgaactacacctgcccgaccttcattgataaaccgggcattcgcattaccgaaggtcgccatccggtagttgaacaagtactgaatgagccatttatcgccaacccgctgaatctgtcgccgcagcgccgcatgttgatcatcaccggtccgaacatgggcggtaaaagtacctatatgcgccagaccgcactgattgcgctgatggcctacatcggcagctatgtaccggcacaaaaagtcgagattggacctatcgatcgcatctttacccgcgtaggcgcggcagatgacctggcgtccgggcgctcaacctttatggtggagatgactgaaaccgccaatattttacataacgccaccgaatacagtctggtgttaatggatgagatcgggcgtggaacgtccacctacgatggtctgtcgctggcgtgggcgtgcgcggaaaatctggcgaataagattaaggcattgacgttatttgctacccactatttcgagctgacccagttaccggagaaaatggaaggcgtcgctaacgtgcatctcgatgcactggagcacggcgacaccattgcctttatgcacagcgtgcaggatggcgcggcgagcaaaagctacggcctggcggttgcagctctggcaggcgtgccaaaagaggttattaagcgcgcacggcaaaagctgcgtgagctggaaagcatttcgccgaacgccgccgctacgcaagtggatggtacgcaaatgtctttgctgtcagtaccagaagaaacttcgcctgcggtcgaagctctggaaaatcttgatccggattcactcaccccgcgtcaggcgctggagtggatttatcgcttgaagagcctggtgtaaacttaattaacggcactcctcagccaagtcaaaagcctccggtcggaggcttttgactacatgcccatggcgtttacgccccgccctgccactcatcgcagtactgttgtaattcattaagcattctgccgacatggaagccatcacaaacggcatgatgaacctgaatcgccagcggcatcagcaccttgtcgccttgcgtataatatttgcccatagtgaaaacgggggcgaagaagttgtccatattggccacgtttaaatcaaaactggtgaaactcacccagggattggctgagacgaaaaacatattctcaataaaccctttagggaaataggccaggttttcaccgtaacacgccacatcttgcgaatatatgtgtagaaactgccggaaatcgtcgtggtattcactccagagcgatgaaaacgtttcagtttgctcatggaaaacggtgtaacaagggtgaacactatcccatatcaccagctcaccgtctttcattgccatacggaactccggatgagcattcatcaggcgggcaagaatgtgaataaaggccggataaaacttgtgcttatttttctttacggtctttaaaaaggccgtaatatccagctgaacggtctggttataggtacattgagtaactgactgaaatgcctcaaaatgttctttacgatgccattgggatatatcaacggtggtatatccagtgatttttttctccattttagcttccttagctcctgaaaatctcgataactcaaaaaatacgcccggtagtgatcttatttcattatggtgaaagttggaacctcttacgtgccaagccaaataggccgt

SEQ ID NO: 81 - DNA, 7619 bp, Artificial Sequence
  Synthetic Polynucleotide
cactcggtcgctacgctccgggcgtgagactgcggcgggcgctgcggacacatacaaagttacccacagattccgtggataagcaggggactaacatgtgaggcaaaacagcagggccgcgccggtggcgtttttccataggctccgccctcctgccagagttcacataaacagacgcttttccggtgcatctgtgggagccgtgaggctcaaccatgaatctgacagtacgggcgaaacccgacaggacttaaagatccccaccgtttccggcgggtcgctccctcttgcgctctcctgttccgaccctgccgtttaccggatacctgttccgcctttctcccttacgggaagtgtggcgctttctcatagctcacacactggtatctcggctcggtgtaggtcgttcgctccaagctgggctgtaagcaagaactccccgttcagcccgactgctgcgccttatccggtaactgttcacttgagtccaacccggaaaagcacggtaaaacgccactggcagcagccattggtaactgggagttcgcagaggatttgtttagctaaacacgcggttgctcttgaagtgtgcgccaaagtccggctacactggaaggacagatttggttgctgtgctctgcgaaagccagttaccacggttaagcagttccccaactgacttaaccttcgatcaaaccacctccccaggtggttttttcgtttacagggcaaaagattacgcgcagaaaaaaaggatctcaagaagatcctttgatcttttctactgaaccgctctagatttcagtgcaatttatctcttcaaatgtagcacctgaagtcagcccaggaggaagaggacatccggtcaaataaaacgaaaggctcagtcgaaagactgggcctttcgttttagacttagggaccctttatgacaacttgacggctacatcattcactttttcttcacaaccggcacggaactcgctcgggctggccccggtgcattttttaaatacccgcgagaaatagagttgatcgtcaaaaccaacattgcgaccgacggtggcgataggcatccgggtggtgctcaaaagcagcttcgcctggctgatacgttggtcctcgcgccagcttaagacgctaatccctaactgctggcggaaaagatgtgacagacgcgacggcgacaagcaaacatgctgtgcgacgctggcgatatcaaaattgctgtctgccaggtgatcgctgatgtactgacaagcctcgcgtacccgattatccatcggtggatggagcgactcgttaatcgcttccatgcgccgcagtaacaattgctcaagcagatttatcgccagcagctccgaatagcgcccttccccttgcccggcgttaatgatttgcccaaacaggtcgctgaaatgcggctggtgcgcttcatccgggcgaaagaaccccgtattggcaaatattgacggccagttaagccattcatgccagtaggcgcgcggacgaaagtaaacccactggtgataccattcgcgagcctccggatgacgaccgtagtgatgaatctctcctggcgggaacagcaaaatatcacccggtcggcaaacaaattctcgtccctgatttttcaccaccccctgaccgcgaatggtgagattgagaatataacctttcattcccagcggtcggtcgataaaaaaatcgagataaccgttggcctcaatcggcgttaaacccgccaccagatgggcattaaacgagtatcccggcagcaggggatcattttgcgcttcagccatacttttcatactcccaccattcagagaagaaaccaattgtccatattgcatcagacattgccgtcactgcgtcttttactggctcttctcgctaacccaaccggtaaccccgcttattaaaagcattctgtaacaaagcgggaccaaagccatgacaaaaacgcgtaacaaaagtgtctataatcacggcagaaaagtccacattgattatttgcacggcgtcacactttgctatgccatagcatttttatccataagattagcggatcctacctgacgctttttatcgcaactctctactgtttctccatacccgtttttttggacgcgtacaactcaagtctgacataaatgaccgctatgagcactgcaattacacgccagatcgttctcgctaccgcaaccaccggtatgaaccagattggtgcgcactatgaaggccacaagatcattgagattggtgccgttgaagtggtgaaccgtcgcctgacgggcaataacttccatgtttatctcaaacccgatcggctggtggatccggaagcctttggcgtacatggtattgccgatgaatttttgctcgataagcccacgtttgccgaagtagccgatgagttcatggactatattcgcggcgcggagttggtgatccataacgcagcgttcgatatcggctttatggactacgagttttcgttgcttaagcgcgatattccgaagaccaatactttctgtaaggtcaccgatagccttgcggtggcgaggaaaatgtttcccggtaagcgcaacagcctcgatgcgttatgtgctcgctacgaaatagataacagtaaacgaacgctgcacggggcattactcgatgcccagatccttgcggaagtttatctggcgatgaccggtggtcaaacgtcgatggcttttgcgatggaaggagagacacaacagcaacaaggtgaagcaacaattcagcgcattgtacgtcaggcaagtaagttacgcgttgtttttgcgacagatgaagagattgcagctcatgaagcccgtctcgatctggtgcagaagaaaggcggaagttgcctctggcgagcataatttaatatcagtaaaccggacataacccatgaagaaaaatcgcgcttttttgaagtgggcagggggcaagtatcccctgcttgatgatattaaacggcatttgcccaagggcgaatgtctggttgagccttttgtaggtgccgggtcggtgtttctcaacaccgacttttctcgttatatccttgccgatatcaatagcgacctgatcagtctctataacattgtgaagatgcgtactgatgagtacgtacaggccgcacgcgagctgtttgttcccgaaacaaattgcgccgaggtttactatcagttccgcgaagagttcaacaaaagccaggatccgttccgtcgggcggtactgtttttatatttgaaccgctacggttacaacggcctgtgtcgttacaatctgcgcggtgagtttaacgtgccgttcggccgctacaaaaaaccctatttcccggaagcagagttgtatcacttcgctgaaaaagcgcagaatgcctttttctattgtgagtcttacgccgatagcatggcgcgcgcagatgatgcatccgtcgtctattgcgatccgccttatgcaccgctgtctgcgaccgccaactttacggcgtatcacacaaacagttttacgcttgaacaacaagcgcatctggcggagatcgccgaaggtctggttgagcgccatattccagtgctgatctccaatcacgatacgatgttaacgcgtgagtggtatcagcgcgcaaaattgcatgtcgtcaaagttcgacgcagtataagcagcaacggcggcacacgtaaaaaggtggacgaactgctggctttgtacaaaccaggagtcgtttcacccgcgaaaaaataattcagctaagacactgcactggattaagatgaaaacgattgaagttgatgatgaactctacagctatattgccagccacactaagcatatcggcgagagcgcatccgacattttacggcgtatgttgaaattttccgccgcatcacagcctgctgctccggtgacgaaagaggttcgcgttgcgtcacctgctatcgtcgaagcgaagccggtcaaaacgattaaagacaaggttcgcgcaatgcgtgaacttctgctttcggatgaatacgcagagcaaaagcgagcggtcaatcgctttatgctgctgttgtctacactatattctcttgacgcccaggcgtttgccgaagcaacggaatcgttgcacggtcgtacacgcgtttactttgcggcagatgaacaaacgctgctgaaaaatggtaatcagaccaagccgaaacatgtgccaggcacgccgtattgggtgatcaccaacaccaacaccggccgtaaatgcagcatgatcgaacacatcatgcagtcgatgcaattcccggcggaattgattgagaaggtttgcggaactatctaacggctgaaattaatgaggtcatacccaaatggatagttcgtttacgcccattgaacaaatgctaaaatttcgcgccagccgccacgaagattttccttatcaggagatccttctgactcgtctttgcatgcacatgcaaagcaagctgctggagaaccgcaataaaatgctgaaggctcagggaattaacgagacgttgtttatggcgttgattacgctggagtctcaggaaaaccacagtattcagccttctgaattaagttgtgctcttggatcatcccgtaccaacgcgacgcgtattgccgatgaactggaaaaacgcggttggatcgaacgtcgtgaaagcgataacgatcgccgctgcctgcatctgcaattaacggaaaaaggtcacgagtttttgcgcgaggttttaccaccgcagcataactgcctgcatcaactctggtccgcgctcagcacaacagaaaaagatcagctcgagcaaatcacccgcaaattgctctcccgtctcgaccagatggaacaagacggtgtggttctcgaagcgatgagctaaatcgcacgctgccaaactaaggacgattgatgccaattcaggtcttaccgccacaactggcgaaccagattgccgcaggtgaggtggtcgagcgacctgcgtcggtagtcaaagaactagtggaaaacagcctcgatgcaggtgcgacgcgtatcgatattgatatcgaacgcggtggggcgaaacttatccgcattcgtgataacggctgcggtatcaaaaaagatgagctggcgctggcgctggctcgtcatgccaccagtaaaatcgcctctctggacgatctcgaagccattatcagcctgggctttcgcgatgaggcgctggcgagtatcagttcggtttcccgcctgacgctcacttcacgcaccgcagaacagcaggaagcctggcaggcctatgccgaagggcgcgatatgaacgtgacggtaaaaccggcggcgcatcctgtggggacgacgctggaggtgctggatctgttctacaacaccccggcgcggcgcaaattcctgcgcaccgagaaaaccgaatttaaccacattgatgagatcatccgccgcattgcgctggcgcgtttcgacgtcacgatcaacctgtcgcataacggtaaaattgtgcgtcagtaccgcgcagtgccggaaggcgggcaaaaagaacggcgcttaggcgcgatttgcggcaccgcttttcttgaacaagcgctggcgattgaatggcaacacggcgatctcacgctacgcggctgggtggccgatccaaatcacaccacgcccgcactggcagaaattcagtattgctacgtgaacggtcgcatgatgcgcgatcgcctgatcaatcacgcgatccgccaggcctgcgaagacaaactgggggccgatcagcaaccggcatttgtgttgtatctggagatcgacccacatcaggtggacgtcaacgtgcaccccgccaaacacgaagtgcgtttccatcagtcgcgtctggtgcatgattttatctatcagggcgtgctgagcgtgctacaacagcaactggaaacgccgctaccgctggacgatgaaccccaacctgcaccgcgttccattccggaaaaccgcgtggcggcggggcgcaatcactttgcagaaccggcagctcgtgagccggtagctccgcgctacactcctgcgccagcatcaggcagtcgtccggctgccccctggccgaatgcgcagccaggctaccagaaacagcaaggtgaagtgtatcgccagcttttgcaaacgcccgcgccgatgcaaaaattaaaagcgccggaaccgcaggaacctgcacttgcggcgaacagtcagagttttggtcgggtactgactatcgtccattccgactgtgcgttgctggagcgcgacggcaacatttcacttttatccttgccagtggcagaacgttggctgcgtcaggcacaattgacgccgggtgaagcgcccgtttgcgcccagccgctgctgattccgttgcggctaaaagtttctgccgaagaaaaatcggcattagaaaaagcgcagtctgccctggcggaattgggtattgatttccagtcagatgcacagcatgtgaccatcagggcagtgcctttacccttacgccaacaaaatttacaaatcttgattcctgaactgataggctacctggcgaagcagtccgtattcgaacctggcaatattgcgcagtggattgcacgaaatctgatgagcgaacatgcgcagtggtcaatggcacaggccataaccctgctggcggacgtggaacggttatgtccgcaacttgtgaaaacgccgccgggtggtctgttacaatctgttgatttacatccggcgataaaagccctgaaagatgagtgaacttaattaacggcactcctcagccaagtcaaaagcctccgaccggaggcttttgactacatgcccatggcgtttacgccccgccctgccactcatcgcagtactgttgtaattcattaagcattctgccgacatggaagccatcacaaacggcatgatgaacctgaatcgccagcggcatcagcaccttgtcgccttgcgtataatatttgcccatagtgaaaacgggggcgaagaagttgtccatattggccacgtttaaatcaaaactggtgaaactcacccagggattggctgagacgaaaaacatattctcaataaaccctttagggaaataggccaggttttcaccgtaacacgccacatcttgcgaatatatgtgtagaaactgccggaaatcgtcgtggtattcactccagagcgatgaaaacgtttcagtttgctcatggaaaacggtgtaacaagggtgaacactatcccatatcaccagctcaccgtctttcattgccatacggaactccggatgagcattcatcaggcgggcaagaatgtgaataaaggccggataaaacttgtgcttatttttctttacggtctttaaaaaggccgtaatatccagctgaacggtctggttataggtacattgagtaactgactgaaatgcctcaaaatgttctttacgatgccattgggatatatcaacggtggtatatccagtgatttttttctccattttagcttccttagctcctgaaaatctcgataactcaaaaaatacgcccggtagtgatcttatttcattatggtgaaagttggaacctcttacgtgccaagccaaataggccgt

SEQ ID NO: 82 - DNA, 8333 bp, Artificial Sequence
  Synthetic Polynucleotide
cactcggtcgctacgctccgggcgtgagactgcggcgggcgctgcggacacatacaaagttacccacagattccgtggataagcaggggactaacatgtgaggcaaaacagcagggccgcgccggtggcgtttttccataggctccgccctcctgccagagttcacataaacagacgcttttccggtgcatctgtgggagccgtgaggctcaaccatgaatctgacagtacgggcgaaacccgacaggacttaaagatccccaccgtttccggcgggtcgctccctcttgcgctctcctgttccgaccctgccgtttaccggatacctgttccgcctttctcccttacgggaagtgtggcgctttctcatagctcacacactggtatctcggctcggtgtaggtcgttcgctccaagctgggctgtaagcaagaactccccgttcagcccgactgctgcgccttatccggtaactgttcacttgagtccaacccggaaaagcacggtaaaacgccactggcagcagccattggtaactgggagttcgcagaggatttgtttagctaaacacgcggttgctcttgaagtgtgcgccaaagtccggctacactggaaggacagatttggttgctgtgctctgcgaaagccagttaccacggttaagcagttccccaactgacttaaccttcgatcaaaccacctccccaggtggttttttcgtttacagggcaaaagattacgcgcagaaaaaaaggatctcaagaagatcctttgatcttttctactgaaccgctctagatttcagtgcaatttatctcttcaaatgtagcacctgaagtcagcccaggaggaagaggacatccggtcaaataaaacgaaaggctcagtcgaaagactgggcctttcgttttagacttagggaccctttatgacaacttgacggctacatcattcactttttcttcacaaccggcacggaactcgctcgggctggccccggtgcattttttaaatacccgcgagaaatagagttgatcgtcaaaaccaacattgcgaccgacggtggcgataggcatccgggtggtgctcaaaagcagcttcgcctggctgatacgttggtcctcgcgccagcttaagacgctaatccctaactgctggcggaaaagatgtgacagacgcgacggcgacaagcaaacatgctgtgcgacgctggcgatatcaaaattgctgtctgccaggtgatcgctgatgtactgacaagcctcgcgtacccgattatccatcggtggatggagcgactcgttaatcgcttccatgcgccgcagtaacaattgctcaagcagatttatcgccagcagctccgaatagcgcccttccccttgcccggcgttaatgatttgcccaaacaggtcgctgaaatgcggctggtgcgcttcatccgggcgaaagaaccccgtattggcaaatattgacggccagttaagccattcatgccagtaggcgcgcggacgaaagtaaacccactggtgataccattcgcgagcctccggatgacgaccgtagtgatgaatctctcctggcgggaacagcaaaatatcacccggtcggcaaacaaattctcgtccctgatttttcaccaccccctgaccgcgaatggtgagattgagaatataacctttcattcccagcggtcggtcgataaaaaaatcgagataaccgttggcctcaatcggcgttaaacccgccaccagatgggcattaaacgagtatcccggcagcaggggatcattttgcgcttcagccatacttttcatactcccaccattcagagaagaaaccaattgtccatattgcatcagacattgccgtcactgcgtcttttactggctcttctcgctaacccaaccggtaaccccgcttattaaaagcattctgtaacaaagcgggaccaaagccatgacaaaaacgcgtaacaaaagtgtctataatcacggcagaaaagtccacattgattatttgcacggcgtcacactttgctatgccatagcatttttatccataagattagcggatcctacctgacgctttttatcgcaactctctactgtttctccatacccgtttttttggacgcgtacaactcaagtctgacataaatgaccgctatgagcactgcaattacacgccagatcgttctcgctaccgcaaccaccggtatgaaccagattggtgcgcactatgaaggccacaagatcattgagattggtgccgttgaagtggtgaaccgtcgcctgacgggcaataacttccatgtttatctcaaacccgatcggctggtggatccggaagcctttggcgtacatggtattgccgatgaatttttgctcgataagcccacgtttgccgaagtagccgatgagttcatggactatattcgcggcgcggagttggtgatccataacgcagcgttcgatatcggctttatggactacgagttttcgttgcttaagcgcgatattccgaagaccaatactttctgtaaggtcaccgatagccttgcggtggcgaggaaaatgtttcccggtaagcgcaacagcctcgatgcgttatgtgctcgctacgaaatagataacagtaaacgaacgctgcacggggcattactcgatgcccagatccttgcggaagtttatctggcgatgaccggtggtcaaacgtcgatggcttttgcgatggaaggagagacacaacagcaacaaggtgaagcaacaattcagcgcattgtacgtcaggcaagtaagttacgcgttgtttttgcgacagatgaagagattgcagctcatgaagcccgtctcgatctggtgcagaagaaaggcggaagttgcctctggcgagcataatttaatatcagtaaaccggacataacccatgaagaaaaatcgcgcttttttgaagtgggcagggggcaagtatcccctgcttgatgatattaaacggcatttgcccaagggcgaatgtctggttgagccttttgtaggtgccgggtcggtgtttctcaacaccgacttttctcgttatatccttgccgatatcaatagcgacctgatcagtctctataacattgtgaagatgcgtactgatgagtacgtacaggccgcacgcgagctgtttgttcccgaaacaaattgcgccgaggtttactatcagttccgcgaagagttcaacaaaagccaggatccgttccgtcgggcggtactgtttttatatttgaaccgctacggttacaacggcctgtgtcgttacaatctgcgcggtgagtttaacgtgccgttcggccgctacaaaaaaccctatttcccggaagcagagttgtatcacttcgctgaaaaagcgcagaatgcctttttctattgtgagtcttacgccgatagcatggcgcgcgcagatgatgcatccgtcgtctattgcgatccgccttatgcaccgctgtctgcgaccgccaactttacggcgtatcacacaaacagttttacgcttgaacaacaagcgcatctggcggagatcgccgaaggtctggttgagcgccatattccagtgctgatctccaatcacgatacgatgttaacgcgtgagtggtatcagcgcgcaaaattgcatgtcgtcaaagttcgacgcagtataagcagcaacggcggcacacgtaaaaaggtggacgaactgctggctttgtacaaaccaggagtcgtttcacccgcgaaaaaataattcagctaagacactgcactggattaagatgaaaacgattgaagttgatgatgaactctacagctatattgccagccacactaagcatatcggcgagagcgcatccgacattttacggcgtatgttgaaattttccgccgcatcacagcctgctgctccggtgacgaaagaggttcgcgttgcgtcacctgctatcgtcgaagcgaagccggtcaaaacgattaaagacaaggttcgcgcaatgcgtgaacttctgctttcggatgaatacgcagagcaaaagcgagcggtcaatcgctttatgctgctgttgtctacactatattctcttgacgcccaggcgtttgccgaagcaacggaatcgttgcacggtcgtacacgcgtttactttgcggcagatgaacaaacgctgctgaaaaatggtaatcagaccaagccgaaacatgtgccaggcacgccgtattgggtgatcaccaacaccaacaccggccgtaaatgcagcatgatcgaacacatcatgcagtcgatgcaattcccggcggaattgattgagaaggtttgcggaactatctaacggctgaaattaatgaggtcatacccaaatggatagttcgtttacgcccattgaacaaatgctaaaatttcgcgccagccgccacgaagattttccttatcaggagatccttctgactcgtctttgcatgcacatgcaaagcaagctgctggagaaccgcaataaaatgctgaaggctcagggaattaacgagacgttgtttatggcgttgattacgctggagtctcaggaaaaccacagtattcagccttctgaattaagttgtgctcttggatcatcccgtaccaacgcgacgcgtattgccgatgaactggaaaaacgcggttggatcgaacgtcgtgaaagcgataacgatcgccgctgcctgcatctgcaattaacggaaaaaggtcacgagtttttgcgcgaggttttaccaccgcagcataactgcctgcatcaactctggtccgcgctcagcacaacagaaaaagatcagctcgagcaaatcacccgcaaattgctctcccgtctcgaccagatggaacaagacggtgtggttctcgaagcgatgagctaatttaatatcagggaaccggacataaccccatgagtgcaatagaaaatttcgacgcccatacgcccatgatgcagcagtatctcaggctgaaagcccagcatcccgagatcctgctgttttaccggatgggtgatttttatgaactgttttatgacgacgcaaaacgcgcgtcgcaactgctggatatttcactgaccaaacgcggtgcttcggcgggagagccgatcccgatggcggggattccctaccatgcggtggaaaactatctcgccaaactggtgaatcagggagagtccgttgccatctgcgaacaaattggcgatccggcgaccagcaaaggtccggttgagcgcaaagttgtgcgtatcgttacgccaggcaccatcagcgatgaagccctgttgcaggagcgtcaggacaacctgctggcggctatctggcaggacagcaaaggtttcggctacgcgacgctggatatcagttccgggcgttttcgcctgagcgaaccggctgaccgcgaaacgatggcggcagaactgcaacgcactaatcctgcggaactgctgtatgcagaagattttgctgaaatgtcgttaattgaaggccgtcgcggcctgcgccgtcgcccgctgtgggagtttgaaatcgacaccgcgcgccagcagttgaatctgcaatttgggacccgcgatctggtcggttttggcgtcgagaacgcgccgcgcggactttgtgctgccggttgtctgttgcagtatgcgaaagatacccaacgtacgactctgccgcatattcgttccatcaccatggaacgtgagcaggacagcatcattatggatgccgcgacgcgtcgtaatctggaaatcacccagaacctggcgggtggtgcggaaaatacgctggcttctgtgctcgactgcaccgtcacgccgatgggcagccgtatgctgaaacgctggctgcatatgccagtgcgcgatacccgcgtgttgcttgagcgccagcaaactattggcgcattgcaggatttcaccgccgggctacagccggtactgcgtcaggtcggcgacctggaacgtattctggcacgtctggctttacgaactgctcgcccacgcgatctggcccgtatgcgccacgctttccagcaactgccggagctgcgtgcgcagttagaaactgtcgatagtgcaccggtacaggcgctacgtgagaagatgggcgagtttgccgagctgcgcgatctgctggagcgagcaatcatcgacacaccgccggtgctggtacgcgacggtggtgttatcgcatcgggctataacgaagagctggatgagtggcgcgcgctggctgacggcgcgaccgattatctggagcgtctggaagtccgcgagcgtgaacgtaccggcctggacacgctgaaagttggctttaatgcggtgcacggctactacattcaaatcagccgtgggcaaagccatctggcacccatcaactacatgcgtcgccagacgctgaaaaacgccgagcgctacatcattccagagctaaaagagtacgaagataaagttctcacctcaaaaggcaaagcactggcactggaaaaacagctttatgaagagctgttcgacctgctgttgccgcatctggaagcgttgcaacagagcgcgagcgcgctggcggaactcgacgtgctggttaacctggcggaacgggcctataccctgaactacacctgcccgaccttcattgataaaccgggcattcgcattaccgaaggtcgccatccggtagttgaacaagtactgaatgagccatttatcgccaacccgctgaatctgtcgccgcagcgccgcatgttgatcatcaccggtccgaacatgggcggtaaaagtacctatatgcgccagaccgcactgattgcgctgatggcctacatcggcagctatgtaccggcacaaaaagtcgagattggacctatcgatcgcatctttacccgcgtaggcgcggcagatgacctggcgtccgggcgctcaacctttatggtggagatgactgaaaccgccaatattttacataacgccaccgaatacagtctggtgttaatggatcagatcgggcgtggaacgtccacctacgatggtctgtcgctggcgtgggcgtgcgcggaaaatctggcgaataagattaaggcattgacgttatttgctacccactatttcgagctgacccagttaccggagaaaatggaaggcgtcgctaacgtgcatctcgatgcactggagcacggcgacaccattgcctttatgcacagcgtgcaggatggcgcggcgagcaaaagctacggcctggcggttgcagctctggcaggcgtgccaaaagaggttattaagcgcgcacggcaaaagctgcgtgagctggaaagcatttcgccgaacgccgccgctacgcaagtggatggtacgcaaatgtctttgctgtcagtaccagaagaaacttcgcctgcggtcgaagctctggaaaatcttgatccggattcactcaccccgcgtcaggcgctggagtggatttatcgcttgaagagcctggtgtaaacttaattaacggcactcctcagccaagtcaaaagcctccgaccggaggcttttgactacatgcccatggcgtttacgccccgccctgccactcatcgcagtactgttgtaattcattaagcattctgccgacatggaagccatcacaaacggcatgatgaacctgaatcgccagcggcatcagcaccttgtcgccttgcgtataatatttgcccatagtgaaaacgggggcgaagaagttgtccatattggccacgtttaaatcaaaactggtgaaactcacccagggattggctgagacgaaaaacatattctcaataaaccctttagggaaataggccaggttttcaccgtaacacgccacatcttgcgaatatatgtgtagaaactgccggaaatcgtcgtggtattcactccagagcgatgaaaacgtttcagtttgctcatggaaaacggtgtaacaagggtgaacactatcccatatcaccagctcaccgtctttcattgccatacggaactccggatgagcattcatcaggcgggcaagaatgtgaataaaggccggataaaacttgtgcttatttttctttacggtctttaaaaaggccgtaatatccagctgaacggtctggttataggtacattgagtaactgactgaaatgcctcaaaatgttctttacgatgccattgggatatatcaacggtggtatatccagtgatttttttctccattttagcttccttagctcctgaaaatctcgataactcaaaaaatacgcccggtagtgatcttatttcattatggtgaaagttggaacctcttacgtgccaagccaaataggccgt

SEQ ID NO: 83 - DNA, 8042 bp, Artificial Sequence
  Synthetic Polynucleotide
cactcggtcgctacgctccgggcgtgagactgcggcgggcgctgcggacacatacaaagttacccacagattccgtggataagcaggggactaacatgtgaggcaaaacagcagggccgcgccggtggcgtttttccataggctccgccctcctgccagagttcacataaacagacgcttttccggtgcatctgtgggagccgtgaggctcaaccatgaatctgacagtacgggcgaaacccgacaggacttaaagatccccaccgtttccggcgggtcgctccctcttgcgctctcctgttccgaccctgccgtttaccggatacctgttccgcctttctcccttacgggaagtgtggcgctttctcatagctcacacactggtatctcggctcggtgtaggtcgttcgctccaagctgggctgtaagcaagaactccccgttcagcccgactgctgcgccttatccggtaactgttcacttgagtccaacccggaaaagcacggtaaaacgccactggcagcagccattggtaactgggagttcgcagaggatttgtttagctaaacacgcggttgctcttgaagtgtgcgccaaagtccggctacactggaaggacagatttggttgctgtgctctgcgaaagccagttaccacggttaagcagttccccaactgacttaaccttcgatcaaaccacctccccaggtggttttttcgtttacagggcaaaagattacgcgcagaaaaaaaggatctcaagaagatcctttgatcttttctactgaaccgctctagatttcagtgcaatttatctcttcaaatgtagcacctgaagtcagcccaggaggaagaggacatccggtcaaataaaacgaaaggctcagtcgaaagactgggcctttcgttttagacttagggaccctttatgacaacttgacggctacatcattcactttttcttcacaaccggcacggaactcgctcgggctggccccggtgcattttttaaatacccgcgagaaatagagttgatcgtcaaaaccaacattgcgaccgacggtggcgataggcatccgggtggtgctcaaaagcagcttcgcctggctgatacgttggtcctcgcgccagcttaagacgctaatccctaactgctggcggaaaagatgtgacagacgcgacggcgacaagcaaacatgctgtgcgacgctggcgatatcaaaattgctgtctgccaggtgatcgctgatgtactgacaagcctcgcgtacccgattatccatcggtggatggagcgactcgttaatcgcttccatgcgccgcagtaacaattgctcaagcagatttatcgccagcagctccgaatagcgcccttccccttgcccggcgttaatgatttgcccaaacaggtcgctgaaatgcggctggtgcgcttcatccgggcgaaagaaccccgtattggcaaatattgacggccagttaagccattcatgccagtaggcgcgcggacgaaagtaaacccactggtgataccattcgcgagcctccggatgacgaccgtagtgatgaatctctcctggcgggaacagcaaaatatcacccggtcggcaaacaaattctcgtccctgatttttcaccaccccctgaccgcgaatggtgagattgagaatataacctttcattcccagcggtcggtcgataaaaaaatcgagataaccgttggcctcaatcggcgttaaacccgccaccagatgggcattaaacgagtatcccggcagcaggggatcattttgcgcttcagccatacttttcatactcccaccattcagagaagaaaccaattgtccatattgcatcagacattgccgtcactgcgtcttttactggctcttctcgctaacccaaccggtaaccccgcttattaaaagcattctgtaacaaagcgggaccaaagccatgacaaaaacgcgtaacaaaagtgtctataatcacggcagaaaagtccacattgattatttgcacggcgtcacactttgctatgccatagcatttttatccataagattagcggatcctacctgacgctttttatcgcaactctctactgtttctccatacccgtttttttggacgcgtacaactcaagtctgacataaatgaccgctatgagcactgcaattacacgccagatcgttctcgctaccgcaaccaccggtatgaaccagattggtgcgcactatgaaggccacaagatcattgagattggtgccgttgaagtggtgaaccgtcgcctgacgggcaataacttccatgtttatctcaaacccgatcggctggtggatccggaagcctttggcgtacatggtattgccgatgaatttttgctcgataagcccacgtttgccgaagtagccgatgagttcatggactatattcgcggcgcggagttggtgatccataacgcagcgttcgatatcggctttatggactacgagttttcgttgcttaagcgcgatattccgaagaccaatactttctgtaaggtcaccgatagccttgcggtggcgaggaaaatgtttcccggtaagcgcaacagcctcgatgcgttatgtgctcgctacgaaatagataacagtaaacgaacgctgcacggggcattactcgatgcccagatccttgcggaagtttatctggcgatgaccggtggtcaaacgtcgatggcttttgcgatggaaggagagacacaacagcaacaaggtgaagcaacaattcagcgcattgtacgtcaggcaagtaagttacgcgttgtttttgcgacagatgaagagattgcagctcatgaagcccgtctcgatctggtgcagaagaaaggcggaagttgcctctggcgagcataatttaatatcagtaaaccggacataacccatgaagaaaaatcgcgcttttttgaagtgggcagggggcaagtatcccctgcttgatgatattaaacggcatttgcccaagggcgaatgtctggttgagccttttgtaggtgccgggtcggtgtttctcaacaccgacttttctcgttatatccttgccgatatcaatagcgacctgatcagtctctataacattgtgaagatgcgtactgatgagtacgtacaggccgcacgcgagctgtttgttcccgaaacaaattgcgccgaggtttactatcagttccgcgaagagttcaacaaaagccaggatccgttccgtcgggcggtactgtttttatatttgaaccgctacggttacaacggcctgtgtcgttacaatctgcgcggtgagtttaacgtgccgttcggccgctacaaaaaaccctatttcccggaagcagagttgtatcacttcgctgaaaaagcgcagaatgcctttttctattgtgagtcttacgccgatagcatggcgcgcgcagatgatgcatccgtcgtctattgcgatccgccttatgcaccgctgtctgcgaccgccaactttacggcgtatcacacaaacagttttacgcttgaacaacaagcgcatctggcggagatcgccgaaggtctggttgagcgccatattccagtgctgatctccaatcacgatacgatgttaacgcgtgagtggtatcagcgcgcaaaattgcatgtcgtcaaagttcgacgcagtataagcagcaacggcggcacacgtaaaaaggtggacgaactgctggctttgtacaaaccaggagtcgtttcacccgcgaaaaaataattcagctaagacactgcactggattaagatgaaaacgattgaagttgatgatgaactctacagctatattgccagccacactaagcatatcggcgagagcgcatccgacattttacggcgtatgttgaaattttccgccgcatcacagcctgctgctccggtgacgaaagaggttcgcgttgcgtcacctgctatcgtcgaagcgaagccggtcaaaacgattaaagacaaggttcgcgcaatgcgtgaacttctgctttcggatgaatacgcagagcaaaagcgagcggtcaatcgctttatgctgctgttgtctacactatattctcttgacgcccaggcgtttgccgaagcaacggaatcgttgcacggtcgtacacgcgtttactttgcggcagatgaacaaacgctgctgaaaaatggtaatcagaccaagccgaaacatgtgccaggcacgccgtattgggtgatcaccaacaccaacaccggccgtaaatgcagcatgatcgaacacatcatgcagtcgatgcaattcccggcggaattgattgagaaggtttgcggaactatctaacggctgaaattaatgaggtcatacccaaatggatagttcgtttacgcccattgaacaaatgctaaaatttcgcgccagccgccacgaagattttccttatcaggagatccttctgactcgtctttgcatgcacatgcaaagcaagctgctggagaaccgcaataaaatgctgaaggctcagggaattaacgagacgttgtttatggcgttgattacgctggagtctcaggaaaaccacagtattcagccttctgaattaagttgtgctcttggatcatcccgtaccaacgcgacgcgtattgccgatgaactggaaaaacgcggttggatcgaacgtcgtgaaagcgataacgatcgccgctgcctgcatctgcaattaacggaaaaaggtcacgagtttttgcgcgaggttttaccaccgcagcataactgcctgcatcaactctggtccgcgctcagcacaacagaaaaagatcagctcgagcaaatcacccgcaaattgctctcccgtctcgaccagatggaacaagacggtgtggttctcgaagcgatgagctaatttaatatcagggaaccggacataaccccatgccggcgaccagcaaaggtccggttgagcgcaaagttgtgcgtatcgttacgccaggcaccatcagcgatgaagccctgttgcaggagcgtcaggacaacctgctggcggctatctggcaggacagcaaaggtttcggctacgcgacgctggatatcagttccgggcgttttcgcctgagcgaaccggctgaccgcgaaacgatggcggcagaactgcaacgcactaatcctgcggaactgctgtatgcagaagattttgctgaaatgtcgttaattgaaggccgtcgcggcctgcgccgtcgcccgctgtgggagtttgaaatcgacaccgcgcgccagcagttgaatctgcaatttgggacccgcgatctggtcggttttggcgtcgagaacgcgccgcgcggactttgtgctgccggttgtctgttgcagtatgcgaaagatacccaacgtacgactctgccgcatattcgttccatcaccatggaacgtgagcaggacagcatcattatggatgccgcgacgcgtcgtaatctggaaatcacccagaacctggcgggtggtgcggaaaatacgctggcttctgtgctcgactgcaccgtcacgccgatgggcagccgtatgctgaaacgctggctgcatatgccagtgcgcgatacccgcgtgttgcttgagcgccagcaaactattggcgcattgcaggatttcaccgccgggctacagccggtactgcgtcaggtcggcgacctggaacgtattctggcacgtctggctttacgaactgctcgcccacgcgatctggcccgtatgcgccacgctttccagcaactgccggagctgcgtgcgcagttagaaactgtcgatagtgcaccggtacaggcgctacgtgagaagatgggcgagtttgccgagctgcgcgatctgctggagcgagcaatcatcgacacaccgccggtgctggtacgcgacggtggtgttatcgcatcgggctataacgaagagctggatgagtggcgcgcgctggctgacggcgcgaccgattatctggagcgtctggaagtccgcgagcgtgaacgtaccggcctggacacgctgaaagttggctttaatgcggtgcacggctactacattcaaatcagccgtgggcaaagccatctggcacccatcaactacatgcgtcgccagacgctgaaaaacgccgagcgctacatcattccagagctaaaagagtacgaagataaagttctcacctcaaaaggcaaagcactggcactggaaaaacagctttatgaagagctgttcgacctgctgttgccgcatctggaagcgttgcaacagagcgcgagcgcgctggcggaactcgacgtgctggttaacctggcggaacgggcctataccctgaactacacctgcccgaccttcattgataaaccgggcattcgcattaccgaaggtcgccatccggtagttgaacaagtactgaatgagccatttatcgccaacccgctgaatctgtcgccgcagcgccgcatgttgatcatcaccggtccgaacatgggcggtaaaagtacctatatgcgccagaccgcactgattgcgctgatggcctacatcggcagctatgtaccggcacaaaaagtcgagattggacctatcgatcgcatctttacccgcgtaggcgcggcagatgacctggcgtccgggcgctcaacctttatggtggagatgactgaaaccgccaatattttacataacgccaccgaatacagtctggtgttaatggatgagatcgggcgtggaacgtccacctacgatggtctgtcgctggcgtgggcgtgcgcggaaaatctggcgaataagattaaggcattgacgttatttgctacccactatttcgagctgacccagttaccggagaaaatggaaggcgtcgctaacgtgcatctcgatgcactggagcacggcgacaccattgcctttatgcacagcgtgcaggatggcgcggcgagcaaaagctacggcctggcggttgcagctctggcaggcgtgccaaaagaggttattaagcgcgcacggcaaaagctgcgtgagctggaaagcatttcgccgaacgccgccgctacgcaagtggatggtacgcaaatgtctttgctgtcagtaccagaagaaacttcgcctgcggtcgaagctctggaaaatcttgatccggattcactcaccccgcgtcaggcgctggagtggatttatcgcttgaagagcctggtgtaaacttaattaacggcactcctcagccaagtcaaaagcctccgaccggaggcttttgactacatgcccatggcgtttacgccccgccctgccactcatcgcagtactgttgtaattcattaagcattctgccgacatggaagccatcacaaacggcatgatgaacctgaatcgccagcggcatcagcaccttgtcgccttgcgtataatatttgcccatagtgaaaacgggggcgaagaagttgtccatattggccacgtttaaatcaaaactggtgaaactcacccagggattggctgagacgaaaaacatattctcaataaaccctttagggaaataggccaggttttcaccgtaacacgccacatcttgcgaatatatgtgtagaaactgccggaaatcgtcgtggtattcactccagagcgatgaaaacgtttcagtttgctcatggaaaacggtgtaacaagggtgaacactatcccatatcaccagctcaccgtctttcattgccatacggaactccggatgagcattcatcaggcgggcaagaatgtgaataaaggccggataaaacttgtgcttatttttctttacggtctttaaaaaggccgtaatatccagctgaacggtctggttataggtacattgagtaactgactgaaatgcctcaaaatgttctttacgatgccattgggatatatcaacggtggtatatccagtgatttttttctccattttagcttccttagctcctgaaaatctcgataactcaaaaaatacgcccggtagtgatcttatttcattatggtgaaagttggaacctcttacgtgccaagccaaataggccgt

SEQ ID NO: 84 - DNA, 6826 bp, Artificial Sequence
  Synthetic Polynucleotide
cactcggtcgctacgctccgggcgtgagactgcggcgggcgctgcggacacatacaaagttacccacagattccgtggataagcaggggactaacatgtgaggcaaaacagcagggccgcgccggtggcgtttttccataggctccgccctcctgccagagttcacataaacagacgcttttccggtgcatctgtgggagccgtgaggctcaaccatgaatctgacagtacgggcgaaacccgacaggacttaaagatccccaccgtttccggcgggtcgctccctcttgcgctctcctgttccgaccctgccgtttaccggatacctgttccgcctttctcccttacgggaagtgtggcgctttctcatagctcacacactggtatctcggctcggtgtaggtcgttcgctccaagctgggctgtaagcaagaactccccgttcagcccgactgctgcgccttatccggtaactgttcacttgagtccaacccggaaaagcacggtaaaacgccactggcagcagccattggtaactgggagttcgcagaggatttgtttagctaaacacgcggttgctcttgaagtgtgcgccaaagtccggctacactggaaggacagatttggttgctgtgctctgcgaaagccagttaccacggttaagcagttccccaactgacttaaccttcgatcaaaccacctccccaggtggttttttcgtttacagggcaaaagattacgcgcagaaaaaaaggatctcaagaagatcctttgatcttttctactgaaccgctctagatttcagtgcaatttatctcttcaaatgtagcacctgaagtcagcccaggaggaagaggacatccggtcaaataaaacgaaaggctcagtcgaaagactgggcctttcgttttagacttagggaccctttatgacaacttgacggctacatcattcactttttcttcacaaccggcacggaactcgctcgggctggccccggtgcattttttaaatacccgcgagaaatagagttgatcgtcaaaaccaacattgcgaccgacggtggcgataggcatccgggtggtgctcaaaagcagcttcgcctggctgatacgttggtcctcgcgccagcttaagacgctaatccctaactgctggcggaaaagatgtgacagacgcgacggcgacaagcaaacatgctgtgcgacgctggcgatatcaaaattgctgtctgccaggtgatcgctgatgtactgacaagcctcgcgtacccgattatccatcggtggatggagcgactcgttaatcgcttccatgcgccgcagtaacaattgctcaagcagatttatcgccagcagctccgaatagcgcccttccccttgcccggcgttaatgatttgcccaaacaggtcgctgaaatgcggctggtgcgcttcatccgggcgaaagaaccccgtattggcaaatattgacggccagttaagccattcatgccagtaggcgcgcggacgaaagtaaacccactggtgataccattcgcgagcctccggatgacgaccgtagtgatgaatctctcctggcgggaacagcaaaatatcacccggtcggcaaacaaattctcgtccctgatttttcaccaccccctgaccgcgaatggtgagattgagaatataacctttcattcccagcggtcggtcgataaaaaaatcgagataaccgttggcctcaatcggcgttaaacccgccaccagatgggcattaaacgagtatcccggcagcaggggatcattttgcgcttcagccatacttttcatactcccaccattcagagaagaaaccaattgtccatattgcatcagacattgccgtcactgcgtcttttactggctcttctcgctaacccaaccggtaaccccgcttattaaaagcattctgtaacaaagcgggaccaaagccatgacaaaaacgcgtaacaaaagtgtctataatcacggcagaaaagtccacattgattatttgcacggcgtcacactttgctatgccatagcatttttatccataagattagcggatcctacctgacgctttttatcgcaactctctactgtttctccatacccgtttttttggacgcgtacaactcaagtctgacataaatgaccgctatgagcactgcaattacacgccagatcgttctcgctaccgcaaccaccggtatgaaccagattggtgcgcactatgaaggccacaagatcattgagattggtgccgttgaagtggtgaaccgtcgcctgacgggcaataacttccatgtttatctcaaacccgatcggctggtggatccggaagcctttggcgtacatggtattgccgatgaatttttgctcgataagcccacgtttgccgaagtagccgatgagttcatggactatattcgcggcgcggagttggtgatccataacgcagcgttcgatatcggctttatggactacgagttttcgttgcttaagcgcgatattccgaagaccaatactttctgtaaggtcaccgatagccttgcggtggcgaggaaaatgtttcccggtaagcgcaacagcctcgatgcgttatgtgctcgctacgaaatagataacagtaaacgaacgctgcacggggcattactcgatgcccagatccttgcggaagtttatctggcgatgaccggtggtcaaacgtcgatggcttttgcgatggaaggagagacacaacagcaacaaggtgaagcaacaattcagcgcattgtacgtcaggcaagtaagttacgcgttgtttttgcgacagatgaagagattgcagctcatgaagcccgtctcgatctggtgcagaagaaaggcggaagttgcctctggcgagcataatttaatatcagtaaaccggacataacccatgaagaaaaatcgcgcttttttgaagtgggcagggggcaagtatcccctgcttgatgatattaaacggcatttgcccaagggcgaatgtctggttgagccttttgtaggtgccgggtcggtgtttctcaacaccgacttttctcgttatatccttgccgatatcaatagcgacctgatcagtctctataacattgtgaagatgcgtactgatgagtacgtacaggccgcacgcgagctgtttgttcccgaaacaaattgcgccgaggtttactatcagttccgcgaagagttcaacaaaagccaggatccgttccgtcgggcggtactgtttttatatttgaaccgctacggttacaacggcctgtgtcgttacaatctgcgcggtgagtttaacgtgccgttcggccgctacaaaaaaccctatttcccggaagcagagttgtatcacttcgctgaaaaagcgcagaatgcctttttctattgtgagtcttacgccgatagcatggcgcgcgcagatgatgcatccgtcgtctattgcgatccgccttatgcaccgctgtctgcgaccgccaactttacggcgtatcacacaaacagttttacgcttgaacaacaagcgcatctggcggagatcgccgaaggtctggttgagcgccatattccagtgctgatctccaatcacgatacgatgttaacgcgtgagtggtatcagcgcgcaaaattgcatgtcgtcaaagttcgacgcagtataagcagcaacggcggcacacgtaaaaaggtggacgaactgctggctttgtacaaaccaggagtcgtttcacccgcgaaaaaataattcagctaagacactgcactggattaagatgaaaacgattgaagttgatgatgaactctacagctatattgccagccacactaagcatatcggcgagagcgcatccgacattttacggcgtatgttgaaattttccgccgcatcacagcctgctgctccggtgacgaaagaggttcgcgttgcgtcacctgctatcgtcgaagcgaagccggtcaaaacgattaaagacaaggttcgcgcaatgcgtgaacttctgctttcggatgaatacgcagagcaaaagcgagcggtcaatcgctttatgctgctgttgtctacactatattctcttgacgcccaggcgtttgccgaagcaacggaatcgttgcacggtcgtacacgcgtttactttgcggcagatgaacaaacgctgctgaaaaatggtaatcagaccaagccgaaacatgtgccaggcacgccgtattgggtgatcaccaacaccaacaccggccgtaaatgcagcatgatcgaacacatcatgcagtcgatgcaattcccggcggaattgattgagaaggtttgcggaactatctaacggctgaaattaatgaggtcatacccaaatggatagttcgtttacgcccattgaacaaatgctaaaatttcgcgccagccgccacgaagattttccttatcaggagatccttctgactcgtctttgcatgcacatgcaaagcaagctgctggagaaccgcaataaaatgctgaaggctcagggaattaacgagacgttgtttatggcgttgattacgctggagtctcaggaaaaccacagtattcagccttctgaattaagttgtgctcttggatcatcccgtaccaacgcgacgcgtattgccgatgaactggaaaaacgcggttggatcgaacgtcgtgaaagcgataacgatcgccgctgcctgcatctgcaattaacggaaaaaggtcacgagtttttgcgcgaggttttaccaccgcagcataactgcctgcatcaactctggtccgcgctcagcacaacagaaaaagatcagctcgagcaaatcacccgcaaattgctctcccgtctcgaccagatggaacaagacggtgtggttctcgaagcgatgagctaaatactttaccagtgttgagaggtgagcaatgcgtaaaatcattcatgtggatatggactgctttttcgccgcagtggagatgcgcgacaatcccgccctgcgcgatatccctattgctattggcggcagccgcgaacgtcggggggtgatcagcaccgccaattatcccgcgcgtaaatttggcgtacgtagcgctatgccgacagggatggcgctcaaattatgcccacatctcaccttgcttccggggcgctttgacgcctacaaagaagcctcaaatcatatccgtgaaatcttctcgcgctacacctcgcgcattgaaccgttgtcactggatgaggcttatctcgatgtcaccgatagcgtccattgccacggttctgcgaccctcatcgcccaggaaatccgccagacaatcttcaacgagctgcaactgacggcgtctgcgggcgtggcaccagtaaagtttctcgccaaaatcgcctccgacatgaataaacccaacggccagtttgtgattacgccggcagaagttccggcatttttacaaaccttaccgctggcaaaaatccccggcgtcggcaaagtctcagcggcaaaactggaagcgatggggctgcggacctgcggtgatgtacaaaagtgtgatctggtgatgctgcttaaacgctttggcaaatttggccgcattttgtgggagcgtagtcaggggattgacgaacgcgatgttaacagcgaacggttgcgaaaatccgtcggcgtggaacgcacgatggcggaagatattcatcactggtctgaatgtgaagcgattatcgagcggctgtatccggaacttgaacgccgtctggcaaaggtaaaacctgatttactgattgctcgccagggggtgaaattaaagttcgacgattttcagcaaaccacccaggagcacgtctggccgcggctgaataaagctgatctaatcgccaccgcgcgtaaaacctgggatgaacgccgcggcgggcgcggtgtgcgtctggtggggctgcatgtgacgttgcttgacccgcaaatggaaagacaactggtgctgggattatgaacttaattaacggcactcctcagccaagtcaaaagcctccgaccggaggcttttgactacatgcccatggcgtttacgccccgccctgccactcatcgcagtactgttgtaattcattaagcattctgccgacatggaagccatcacaaacggcatgatgaacctgaatcgccagcggcatcagcaccttgtcgccttgcgtataatatttgcccatagtgaaaacgggggcgaagaagttgtccatattggccacgtttaaatcaaaactggtgaaactcacccagggattggctgagacgaaaaacatattctcaataaaccctttagggaaataggccaggttttcaccgtaacacgccacatcttgcgaatatatgtgtagaaactgccggaaatcgtcgtggtattcactccagagcgatgaaaacgtttcagtttgctcatggaaaacggtgtaacaagggtgaacactatcccatatcaccagctcaccgtctttcattgccatacggaactccggatgagcattcatcaggcgggcaagaatgtgaataaaggccggataaaacttgtgcttatttttctttacggtctttaaaaaggccgtaatatccagctgaacggtctggttataggtacattgagtaactgactgaaatgcctcaaaatgttctttacgatgccattgggatatatcaacggtggtatatccagtgatttttttctccattttagcttccttagctcctgaaaatctcgataactcaaaaaatacgcccggtagtgatcttatttcattatggtgaaagttggaacctcttacgtgccaagccaaataggccgt

SEQ ID NO: 85 - DNA, 8122 bp, Artificial Sequence
  Synthetic Polynucleotide
cactcggtcgctacgctccgggcgtgagactgcggcgggcgctgcggacacatacaaagttacccacagattccgtggataagcaggggactaacatgtgaggcaaaacagcagggccgcgccggtggcgtttttccataggctccgccctcctgccagagttcacataaacagacgcttttccggtgcatctgtgggagccgtgaggctcaaccatgaatctgacagtacgggcgaaacccgacaggacttaaagatccccaccgtttccggcgggtcgctccctcttgcgctctcctgttccgaccctgccgtttaccggatacctgttccgcctttctcccttacgggaagtgtggcgctttctcatagctcacacactggtatctcggctcggtgtaggtcgttcgctccaagctgggctgtaagcaagaactccccgttcagcccgactgctgcgccttatccggtaactgttcacttgagtccaacccggaaaagcacggtaaaacgccactggcagcagccattggtaactgggagttcgcagaggatttgtttagctaaacacgcggttgctcttgaagtgtgcgccaaagtccggctacactggaaggacagatttggttgctgtgctctgcgaaagccagttaccacggttaagcagttccccaactgacttaaccttcgatcaaaccacctccccaggtggttttttcgtttacagggcaaaagattacgcgcagaaaaaaaggatctcaagaagatcctttgatcttttctactgaaccgctctagatttcagtgcaatttatctcttcaaatgtagcacctgaagtcagcccaggaggaagaggacatccggtcaaataaaacgaaaggctcagtcgaaagactgggcctttcgttttagacttagggaccctttatgacaacttgacggctacatcattcactttttcttcacaaccggcacggaactcgctcgggctggccccggtgcattttttaaatacccgcgagaaatagagttgatcgtcaaaaccaacattgcgaccgacggtggcgataggcatccgggtggtgctcaaaagcagcttcgcctggctgatacgttggtcctcgcgccagcttaagacgctaatccctaactgctggcggaaaagatgtgacagacgcgacggcgacaagcaaacatgctgtgcgacgctggcgatatcaaaattgctgtctgccaggtgatcgctgatgtactgacaagcctcgcgtacccgattatccatcggtggatggagcgactcgttaatcgcttccatgcgccgcagtaacaattgctcaagcagatttatcgccagcagctccgaatagcgcccttccccttgcccggcgttaatgatttgcccaaacaggtcgctgaaatgcggctggtgcgcttcatccgggcgaaagaaccccgtattggcaaatattgacggccagttaagccattcatgccagtaggcgcgcggacgaaagtaaacccactggtgataccattcgcgagcctccggatgacgaccgtagtgatgaatctctcctggcgggaacagcaaaatatcacccggtcggcaaacaaattctcgtccctgatttttcaccaccccctgaccgcgaatggtgagattgagaatataacctttcattcccagcggtcggtcgataaaaaaatcgagataaccgttggcctcaatcggcgttaaacccgccaccagatgggcattaaacgagtatcccggcagcaggggatcattttgcgcttcagccatacttttcatactcccaccattcagagaagaaaccaattgtccatattgcatcagacattgccgtcactgcgtcttttactggctcttctcgctaacccaaccggtaaccccgcttattaaaagcattctgtaacaaagcgggaccaaagccatgacaaaaacgcgtaacaaaagtgtctataatcacggcagaaaagtccacattgattatttgcacggcgtcacactttgctatgccatagcatttttatccataagattagcggatcctacctgacgctttttatcgcaactctctactgtttctccatacccgtttttttggacgcgtacaactcaagtctgacataaatgaccgctatgagcactgcaattacacgccagatcgttctcgctaccgcaaccaccggtatgaaccagattggtgcgcactatgaaggccacaagatcattgagattggtgccgttgaagtggtgaaccgtcgcctgacgggcaataacttccatgtttatctcaaacccgatcggctggtggatccggaagcctttggcgtacatggtattgccgatgaatttttgctcgataagcccacgtttgccgaagtagccgatgagttcatggactatattcgcggcgcggagttggtgatccataacgcagcgttcgatatcggctttatggactacgagttttcgttgcttaagcgcgatattccgaagaccaatactttctgtaaggtcaccgatagccttgcggtggcgaggaaaatgtttcccggtaagcgcaacagcctcgatgcgttatgtgctcgctacgaaatagataacagtaaacgaacgctgcacggggcattactcgatgcccagatccttgcggaagtttatctggcgatgaccggtggtcaaacgtcgatggcttttgcgatggaaggagagacacaacagcaacaaggtgaagcaacaattcagcgcattgtacgtcaggcaagtaagttacgcgttgtttttgcgacagatgaagagattgcagctcatgaagcccgtctcgatctggtgcagaagaaaggcggaagttgcctctggcgagcataatttaatatcagtaaaccggacataacccatgaagaaaaatcgcgcttttttgaagtgggcagggggcaagtatcccctgcttgatgatattaaacggcatttgcccaagggcgaatgtctggttgagccttttgtaggtgccgggtcggtgtttctcaacaccgacttttctcgttatatccttgccgatatcaatagcgacctgatcagtctctataacattgtgaagatgcgtactgatgagtacgtacaggccgcacgcgagctgtttgttcccgaaacaaattgcgccgaggtttactatcagttccgcgaagagttcaacaaaagccaggatccgttccgtcgggcggtactgtttttatatttgaaccgctacggttacaacggcctgtgtcgttacaatctgcgcggtgagtttaacgtgccgttcggccgctacaaaaaaccctatttcccggaagcagagttgtatcacttcgctgaaaaagcgcagaatgcctttttctattgtgagtcttacgccgatagcatggcgcgcgcagatgatgcatccgtcgtctattgcgatccgccttatgcaccgctgtctgcgaccgccaactttacggcgtatcacacaaacagttttacgcttgaacaacaagcgcatctggcggagatcgccgaaggtctggttgagcgccatattccagtgctgatctccaatcacgatacgatgttaacgcgtgagtggtatcagcgcgcaaaattgcatgtcgtcaaagttcgacgcagtataagcagcaacggcggcacacgtaaaaaggtggacgaactgctggctttgtacaaaccaggagtcgtttcacccgcgaaaaaataattcagctaagacactgcactggattaagatgaaaacgattgaagttgatgatgaactctacagctatattgccagccacactaagcatatcggcgagagcgcatccgacattttacggcgtatgttgaaattttccgccgcatcacagcctgctgctccggtgacgaaagaggttcgcgttgcgtcacctgctatcgtcgaagcgaagccggtcaaaacgattaaagacaaggttcgcgcaatgcgtgaacttctgctttcggatgaatacgcagagcaaaagcgagcggtcaatcgctttatgctgctgttgtctacactatattctcttgacgcccaggcgtttgccgaagcaacggaatcgttgcacggtcgtacacgcgtttactttgcggcagatgaacaaacgctgctgaaaaatggtaatcagaccaagccgaaacatgtgccaggcacgccgtattgggtgatcaccaacaccaacaccggccgtaaatgcagcatgatcgaacacatcatgcagtcgatgcaattcccggcggaattgattgagaaggtttgcggaactatctaacggctgaaattaatgaggtcatacccaaatggatagttcgtttacgcccattgaacaaatgctaaaatttcgcgccagccgccacgaagattttccttatcaggagatccttctgactcgtctttgcatgcacatgcaaagcaagctgctggagaaccgcaataaaatgctgaaggctcagggaattaacgagacgttgtttatggcgttgattacgctggagtctcaggaaaaccacagtattcagccttctgaattaagttgtgctcttggatcatcccgtaccaacgcgacgcgtattgccgatgaactggaaaaacgcggttggatcgaacgtcgtgaaagcgataacgatcgccgctgcctgcatctgcaattaacggaaaaaggtcacgagtttttgcgcgaggttttaccaccgcagcataactgcctgcatcaactctggtccgcgctcagcacaacagaaaaagatcagctcgagcaaatcacccgcaaattgctctcccgtctcgaccagatggaacaagacggtgtggttctcgaagcgatgagctaaaagcctggttttttgatggaattacagcatggcgcaggcaggttttatcttaacccgacactggcgggacaccccgcaagggacagaagtctccttctggctggcgacggacaacgggccgttgcaggttacgcttgcaccgcaagagtccgtggcgtttattcccgccgatcaggttccccgcgctcagcatattttgcagggtgaacaaggcgttcgcctgacaccgctggcgttaaaggattttcaccgccagccggtgtatggcctttactgtcgcgcccatcgccaattgatgaattacgaaaagcgcctgcgtgaaggtggcgttaccgtctacgaggccgatgtgcgcccgccagaacgctatctgatggagcggtttatcacctcaccggtgtgggtcgagggtgatatgcacaatggcgctatcgttaatgcccgtctgaaaccgcatcccgactatcgtccgccgctcaagtgggtttctattgatattgaaaccacccgccacggtgagctgtactgcatcggcctggaaggctgcgggcagcgcatcgtttatatgctggggccagagaatggcgacgcctccgcgctcgattttgaactggaatacgtcgccagccgcccgcagctactggaaaaactcaacgcctggtttgccaactacgatcctgatgtgatcatcggttggaacgtggtgcagttcgatctgcgaatgctgcaaaaacatgccgagcgttaccgtattccgctgcggctggggcgcgataacagtgagctggagtggcgcgagcacggctttaaaaacggcgtcttttttgcccaggctaaaggtcggctaattatcgacggtatcgaggcgctgaaatccgcgttctggaatttctcttcattctcgctggaaaccgtcgctcaggagttattaggcgaaggaaaatctatcgataacccgtgggatcgaatggacgaaattgaccgccgtttcgccgaagataaacctgcgctggcgacttataacctgaaagattgcgagctggtgacgcagattttccataaaactgaaatcatgccatttttactcgaacgagcgacggtgaacggcctgccggtagaccgccacgggggatcggtggcggcgtttggtcatctctattttcctcgtatgcaccgcgctggttatgtcgcgcctaatctcggcgaagtgccgccacacgccagccctggcggctacgtgatggattcacggccagggctttatgattcggtactggtgctggactataaaagcctgtacccgtcgatcatccgcacctttctgattgatcccgtcgggctggtggaaggcatggcgcagcctgatccagagcacagtaccgaaggttttctcgatgcctggttctcgcgagaaaaacattgcctgccggagattgtgactaacatctggcacgggcgcgatgaagccaaacgccagggtaacaaaccgctgtcgcaggcgctgaaaatcatcatgaatgccttttatggcgtgctcggcaccaccgcctgccgcttcttcgatccgcggctggcatcgtcgatcaccatgcgtggtcatcagatcatgcggcaaaccaaagcgttgattgaagcacagggctacgacgttatctacggcgataccgactcaacgtttgtctggctgaaaggcgcacattcggaagaagaagcggcgaaaatcggtcgtgcactggtgcagcacgttaacgcctggtgggcggaaacgctgcaaaaacaacggctgaccagcgcattagaactggagtatgaaacccatttctgccgttttctgatgccaaccattcgcggagccgataccggcagtaaaaagcgttatgccggactgattcaggagggcgacaagcagcggatggtgtttaaagggctggaaaccgtgcgcaccgactggacgccgctggcccagcagtttcagcaggagctatacctgcgcatcttccgcaacgagccatatcaggaatatgtacgcgaaaccatcgacaaactgatggcgggtgaactggatgcgcgactggtttaccgtaaacgccttcgccgtccgctgagcgagtatcagcgtaatgtgccgcctcatgtacgcgccgctcgccttgccgatgaagaaaaccaaaagcgtggtcgccccttgcaatatcagaatcgcggcaccattaagtacgtatggaccaccaacggcccggagccgctggactaccaacgttcaccactggattacgaacactatctgacccgccagctacaacccgtggcggagggaatactcccttttattgaggataattttgctacacttatgaccgggcaacttgggctattttaaacttaattaacggcactcctcagccaagtcaaaagcctccgaccggaggcttttgactacatgcccatggcgtttacgccccgccctgccactcatcgcagtactgttgtaattcattaagcattctgccgacatggaagccatcacaaacggcatgatgaacctgaatcgccagcggcatcagcaccttgtcgccttgcgtataatatttgcccatagtgaaaacgggggcgaagaagttgtccatattggccacgtttaaatcaaaactggtgaaactcacccagggattggctgagacgaaaaacatattctcaataaaccctttagggaaataggccaggttttcaccgtaacacgccacatcttgcgaatatatgtgtagaaactgccggaaatcgtcgtggtattcactccagagcgatgaaaacgtttcagtttgctcatggaaaacggtgtaacaagggtgaacactatcccatatcaccagctcaccgtctttcattgccatacggaactccggatgagcattcatcaggcgggcaagaatgtgaataaaggccggataaaacttgtgcttatttttctttacggtctttaaaaaggccgtaatatccagctgaacggtctggttataggtacattgagtaactgactgaaatgcctcaaaatgttctttacgatgccattgggatatatcaacggtggtatatccagtgatttttttctccattttagcttccttagctcctgaaaatctcgataactcaaaaaatacgcccggtagtgatcttatttcattatggtgaaagttggaacctcttacgtgccaagccaaataggccgt

SEQ ID NO: 86 - DNA, 6651 bp, Artificial Sequence
  Synthetic Polynucleotide
cactcggtcgctacgctccgggcgtgagactgcggcgggcgctgcggacacatacaaagttacccacagattccgtggataagcaggggactaacatgtgaggcaaaacagcagggccgcgccggtggcgtttttccataggctccgccctcctgccagagttcacataaacagacgcttttccggtgcatctgtgggagccgtgaggctcaaccatgaatctgacagtacgggcgaaacccgacaggacttaaagatccccaccgtttccggcgggtcgctccctcttgcgctctcctgttccgaccctgccgtttaccggatacctgttccgcctttctcccttacgggaagtgtggcgctttctcatagctcacacactggtatctcggctcggtgtaggtcgttcgctccaagctgggctgtaagcaagaactccccgttcagcccgactgctgcgccttatccggtaactgttcacttgagtccaacccggaaaagcacggtaaaacgccactggcagcagccattggtaactgggagttcgcagaggatttgtttagctaaacacgcggttgctcttgaagtgtgcgccaaagtccggctacactggaaggacagatttggttgctgtgctctgcgaaagccagttaccacggttaagcagttccccaactgacttaaccttcgatcaaaccacctccccaggtggttttttcgtttacagggcaaaagattacgcgcagaaaaaaaggatctcaagaagatcctttgatcttttctactgaaccgctctagatttcagtgcaatttatctcttcaaatgtagcacctgaagtcagcccaggaggaagaggacatccggtcaaataaaacgaaaggctcagtcgaaagactgggcctttcgttttagacttagggaccctttatgacaacttgacggctacatcattcactttttcttcacaaccggcacggaactcgctcgggctggccccggtgcattttttaaatacccgcgagaaatagagttgatcgtcaaaaccaacattgcgaccgacggtggcgataggcatccgggtggtgctcaaaagcagcttcgcctggctgatacgttggtcctcgcgccagcttaagacgctaatccctaactgctggcggaaaagatgtgacagacgcgacggcgacaagcaaacatgctgtgcgacgctggcgatatcaaaattgctgtctgccaggtgatcgctgatgtactgacaagcctcgcgtacccgattatccatcggtggatggagcgactcgttaatcgcttccatgcgccgcagtaacaattgctcaagcagatttatcgccagcagctccgaatagcgcccttccccttgcccggcgttaatgatttgcccaaacaggtcgctgaaatgcggctggtgcgcttcatccgggcgaaagaaccccgtattggcaaatattgacggccagttaagccattcatgccagtaggcgcgcggacgaaagtaaacccactggtgataccattcgcgagcctccggatgacgaccgtagtgatgaatctctcctggcgggaacagcaaaatatcacccggtcggcaaacaaattctcgtccctgatttttcaccaccccctgaccgcgaatggtgagattgagaatataacctttcattcccagcggtcggtcgataaaaaaatcgagataaccgttggcctcaatcggcgttaaacccgccaccagatgggcattaaacgagtatcccggcagcaggggatcattttgcgcttcagccatacttttcatactcccaccattcagagaagaaaccaattgtccatattgcatcagacattgccgtcactgcgtcttttactggctcttctcgctaacccaaccggtaaccccgcttattaaaagcattctgtaacaaagcgggaccaaagccatgacaaaaacgcgtaacaaaagtgtctataatcacggcagaaaagtccacattgattatttgcacggcgtcacactttgctatgccatagcatttttatccataagattagcggatcctacctgacgctttttatcgcaactctctactgtttctccatacccgtttttttggacgcgtacaactcaagtctgacataaatgaccgctatgagcactgcaattacacgccagatcgttctcgctaccgcaaccaccggtatgaaccagattggtgcgcactatgaaggccacaagatcattgagattggtgccgttgaagtggtgaaccgtcgcctgacgggcaataacttccatgtttatctcaaacccgatcggctggtggatccggaagcctttggcgtacatggtattgccgatgaatttttgctcgataagcccacgtttgccgaagtagccgatgagttcatggactatattcgcggcgcggagttggtgatccataacgcagcgttcgatatcggctttatggactacgagttttcgttgcttaagcgcgatattccgaagaccaatactttctgtaaggtcaccgatagccttgcggtggcgaggaaaatgtttcccggtaagcgcaacagcctcgatgcgttatgtgctcgctacgaaatagataacagtaaacgaacgctgcacggggcattactcgatgcccagatccttgcggaagtttatctggcgatgaccggtggtcaaacgtcgatggcttttgcgatggaaggagagacacaacagcaacaaggtgaagcaacaattcagcgcattgtacgtcaggcaagtaagttacgcgttgtttttgcgacagatgaagagattgcagctcatgaagcccgtctcgatctggtgcagaagaaaggcggaagttgcctctggcgagcataatttaatatcagtaaaccggacataacccatgaagaaaaatcgcgcttttttgaagtgggcagggggcaagtatcccctgcttgatgatattaaacggcatttgcccaagggcgaatgtctggttgagccttttgtaggtgccgggtcggtgtttctcaacaccgacttttctcgttatatccttgccgatatcaatagcgacctgatcagtctctataacattgtgaagatgcgtactgatgagtacgtacaggccgcacgcgagctgtttgttcccgaaacaaattgcgccgaggtttactatcagttccgcgaagagttcaacaaaagccaggatccgttccgtcgggcggtactgtttttatatttgaaccgctacggttacaacggcctgtgtcgttacaatctgcgcggtgagtttaacgtgccgttcggccgctacaaaaaaccctatttcccggaagcagagttgtatcacttcgctgaaaaagcgcagaatgcctttttctattgtgagtcttacgccgatagcatggcgcgcgcagatgatgcatccgtcgtctattgcgatccgccttatgcaccgctgtctgcgaccgccaactttacggcgtatcacacaaacagttttacgcttgaacaacaagcgcatctggcggagatcgccgaaggtctggttgagcgccatattccagtgctgatctccaatcacgatacgatgttaacgcgtgagtggtatcagcgcgcaaaattgcatgtcgtcaaagttcgacgcagtataagcagcaacggcggcacacgtaaaaaggtggacgaactgctggctttgtacaaaccaggagtcgtttcacccgcgaaaaaataattcagctaagacactgcactggattaagatgaaaacgattgaagttgatgatgaactctacagctatattgccagccacactaagcatatcggcgagagcgcatccgacattttacggcgtatgttgaaattttccgccgcatcacagcctgctgctccggtgacgaaagaggttcgcgttgcgtcacctgctatcgtcgaagcgaagccggtcaaaacgattaaagacaaggttcgcgcaatgcgtgaacttctgctttcggatgaatacgcagagcaaaagcgagcggtcaatcgctttatgctgctgttgtctacactatattctcttgacgcccaggcgtttgccgaagcaacggaatcgttgcacggtcgtacacgcgtttactttgcggcagatgaacaaacgctgctgaaaaatggtaatcagaccaagccgaaacatgtgccaggcacgccgtattgggtgatcaccaacaccaacaccggccgtaaatgcagcatgatcgaacacatcatgcagtcgatgcaattcccggcggaattgattgagaaggtttgcggaactatctaacggctgaaattaatgaggtcatacccaaatggatagttcgtttacgcccattgaacaaatgctaaaatttcgcgccagccgccacgaagattttccttatcaggagatccttctgactcgtctttgcatgcacatgcaaagcaagctgctggagaaccgcaataaaatgctgaaggctcagggaattaacgagacgttgtttatggcgttgattacgctggagtctcaggaaaaccacagtattcagccttctgaattaagttgtgctcttggatcatcccgtaccaacgcgacgcgtattgccgatgaactggaaaaacgcggttggatcgaacgtcgtgaaagcgataacgatcgccgctgcctgcatctgcaattaacggaaaaaggtcacgagtttttgcgcgaggttttaccaccgcagcataactgcctgcatcaactctggtccgcgctcagcacaacagaaaaagatcagctcgagcaaatcacccgcaaattgctctcccgtctcgaccagatggaacaagacggtgtggttctcgaagcgatgagctaataatacaaaaattaggaggaatttcaacatgacaaatttatctgacatcattgaaaaagaaacaggaaaacaactagtgattcaagaatcaattctaatgttaccagaagaagtagaggaagtaattgggaataaaccagaaagtgatattttagttcatactgcttatgatgaaagtacagatgaaaatgtaatgctattaacttcagatgctccagaatataaaccttgggctttagtaattcaagacagtaatggagaaaataaaattaaaatgttataagtcgagattaagtaaaccggaatctgaagatggactctctgctgatgaaccgtcgtaaattcctgtaccagttcaaaaacgttcgttgggcgaaaggtcgtcgtgaaacctacctgtgctacgttgttaaacgtcgtgactctgcgacctctttctctctggacttcggttacctgcgtaacaaaaacggttgccacgttgaactgctgttcctgcgttacatctctgactgggacctggacccgggtcgttgctaccgtgttacctggttcacctcttggtctccgtgctacgactgcgcgcgtcacgttgcggacttcctgcgtggtaacccgaacctgtctctgcgtatcttcaccgcgcgtctgtacttctgcgaagaccgtaaagcggaaccggaaggtctgcgtcgtctgcaccgtgcgggtgttcagatcgcgatcatgaccttcaaagactacttctactgctggaacaccttcgttgaaaaccacgaacgtaccttcaaagcgtgggaaggtctgcacgaaaactctgttcgtctgtctcgtcagctgcgtcgtatcctgctgccgctgtacgaagttgacgacctgcgtgacgcgttccgtaccctgggtctgtaaacttaattaacggcactcctcagccaagtcaaaagcctccgaccggaggcttttgactacatgcccatggcgtttacgccccgccctgccactcatcgcagtactgttgtaattcattaagcattctgccgacatggaagccatcacaaacggcatgatgaacctgaatcgccagcggcatcagcaccttgtcgccttgcgtataatatttgcccatagtgaaaacgggggcgaagaagttgtccatattggccacgtttaaatcaaaactggtgaaactcacccagggattggctgagacgaaaaacatattctcaataaaccctttagggaaataggccaggttttcaccgtaacacgccacatcttgcgaatatatgtgtagaaactgccggaaatcgtcgtggtattcactccagagcgatgaaaacgtttcagtttgctcatggaaaacggtgtaacaagggtgaacactatcccatatcaccagctcaccgtctttcattgccatacggaactccggatgagcattcatcaggcgggcaagaatgtgaataaaggccggataaaacttgtgcttatttttctttacggtctttaaaaaggccgtaatatccagctgaacggtctggttataggtacattgagtaactgactgaaatgcctcaaaatgttctttacgatgccattgggatatatcaacggtggtatatccagtgatttttttctccattttagcttccttagctcctgaaaatctcgataactcaaaaaatacgcccggtagtgatcttatttcattatggtgaaagttggaacctcttacgtgccaagccaaataggccgt

SEQ ID NO: 87 - DNA, 6744 bp, Artificial Sequence
  Synthetic Polynucleotide
cactcggtcgctacgctccgggcgtgagactgcggcgggcgctgcggacacatacaaagttacccacagattccgtggataagcaggggactaacatgtgaggcaaaacagcagggccgcgccggtggcgtttttccataggctccgccctcctgccagagttcacataaacagacgcttttccggtgcatctgtgggagccgtgaggctcaaccatgaatctgacagtacgggcgaaacccgacaggacttaaagatccccaccgtttccggcgggtcgctccctcttgcgctctcctgttccgaccctgccgtttaccggatacctgttccgcctttctcccttacgggaagtgtggcgctttctcatagctcacacactggtatctcggctcggtgtaggtcgttcgctccaagctgggctgtaagcaagaactccccgttcagcccgactgctgcgccttatccggtaactgttcacttgagtccaacccggaaaagcacggtaaaacgccactggcagcagccattggtaactgggagttcgcagaggatttgtttagctaaacacgcggttgctcttgaagtgtgcgccaaagtccggctacactggaaggacagatttggttgctgtgctctgcgaaagccagttaccacggttaagcagttccccaactgacttaaccttcgatcaaaccacctccccaggtggttttttcgtttacagggcaaaagattacgcgcagaaaaaaaggatctcaagaagatcctttgatcttttctactgaaccgctctagatttcagtgcaatttatctcttcaaatgtagcacctgaagtcagcccaggaggaagaggacatccggtcaaataaaacgaaaggctcagtcgaaagactgggcctttcgttttagacttagggaccctttatgacaacttgacggctacatcattcactttttcttcacaaccggcacggaactcgctcgggctggccccggtgcattttttaaatacccgcgagaaatagagttgatcgtcaaaaccaacattgcgaccgacggtggcgataggcatccgggtggtgctcaaaagcagcttcgcctggctgatacgttggtcctcgcgccagcttaagacgctaatccctaactgctggcggaaaagatgtgacagacgcgacggcgacaagcaaacatgctgtgcgacgctggcgatatcaaaattgctgtctgccaggtgatcgctgatgtactgacaagcctcgcgtacccgattatccatcggtggatggagcgactcgttaatcgcttccatgcgccgcagtaacaattgctcaagcagatttatcgccagcagctccgaatagcgcccttccccttgcccggcgttaatgatttgcccaaacaggtcgctgaaatgcggctggtgcgcttcatccgggcgaaagaaccccgtattggcaaatattgacggccagttaagccattcatgccagtaggcgcgcggacgaaagtaaacccactggtgataccattcgcgagcctccggatgacgaccgtagtgatgaatctctcctggcgggaacagcaaaatatcacccggtcggcaaacaaattctcgtccctgatttttcaccaccccctgaccgcgaatggtgagattgagaatataacctttcattcccagcggtcggtcgataaaaaaatcgagataaccgttggcctcaatcggcgttaaacccgccaccagatgggcattaaacgagtatcccggcagcaggggatcattttgcgcttcagccatacttttcatactcccaccattcagagaagaaaccaattgtccatattgcatcagacattgccgtcactgcgtcttttactggctcttctcgctaacccaaccggtaaccccgcttattaaaagcattctgtaacaaagcgggaccaaagccatgacaaaaacgcgtaacaaaagtgtctataatcacggcagaaaagtccacattgattatttgcacggcgtcacactttgctatgccatagcatttttatccataagattagcggatcctacctgacgctttttatcgcaactctctactgtttctccatacccgtttttttggacgcgtacaactcaagtctgacataaatgaccgctatgagcactgcaattacacgccagatcgttctcgctaccgcaaccaccggtatgaaccagattggtgcgcactatgaaggccacaagatcattgagattggtgccgttgaagtggtgaaccgtcgcctgacgggcaataacttccatgtttatctcaaacccgatcggctggtggatccggaagcctttggcgtacatggtattgccgatgaatttttgctcgataagcccacgtttgccgaagtagccgatgagttcatggactatattcgcggcgcggagttggtgatccataacgcagcgttcgatatcggctttatggactacgagttttcgttgcttaagcgcgatattccgaagaccaatactttctgtaaggtcaccgatagccttgcggtggcgaggaaaatgtttcccggtaagcgcaacagcctcgatgcgttatgtgctcgctacgaaatagataacagtaaacgaacgctgcacggggcattactcgatgcccagatccttgcggaagtttatctggcgatgaccggtggtcaaacgtcgatggcttttgcgatggaaggagagacacaacagcaacaaggtgaagcaacaattcagcgcattgtacgtcaggcaagtaagttacgcgttgtttttgcgacagatgaagagattgcagctcatgaagcccgtctcgatctggtgcagaagaaaggcggaagttgcctctggcgagcataatttaatatcagtaaaccggacataacccatgaagaaaaatcgcgcttttttgaagtgggcagggggcaagtatcccctgcttgatgatattaaacggcatttgcccaagggcgaatgtctggttgagccttttgtaggtgccgggtcggtgtttctcaacaccgacttttctcgttatatccttgccgatatcaatagcgacctgatcagtctctataacattgtgaagatgcgtactgatgagtacgtacaggccgcacgcgagctgtttgttcccgaaacaaattgcgccgaggtttactatcagttccgcgaagagttcaacaaaagccaggatccgttccgtcgggcggtactgtttttatatttgaaccgctacggttacaacggcctgtgtcgttacaatctgcgcggtgagtttaacgtgccgttcggccgctacaaaaaaccctatttcccggaagcagagttgtatcacttcgctgaaaaagcgcagaatgcctttttctattgtgagtcttacgccgatagcatggcgcgcgcagatgatgcatccgtcgtctattgcgatccgccttatgcaccgctgtctgcgaccgccaactttacggcgtatcacacaaacagttttacgcttgaacaacaagcgcatctggcggagatcgccgaaggtctggttgagcgccatattccagtgctgatctccaatcacgatacgatgttaacgcgtgagtggtatcagcgcgcaaaattgcatgtcgtcaaagttcgacgcagtataagcagcaacggcggcacacgtaaaaaggtggacgaactgctggctttgtacaaaccaggagtcgtttcacccgcgaaaaaataattcagctaagacactgcactggattaagatgaaaacgattgaagttgatgatgaactctacagctatattgccagccacactaagcatatcggcgagagcgcatccgacattttacggcgtatgttgaaattttccgccgcatcacagcctgctgctccggtgacgaaagaggttcgcgttgcgtcacctgctatcgtcgaagcgaagccggtcaaaacgattaaagacaaggttcgcgcaatgcgtgaacttctgctttcggatgaatacgcagagcaaaagcgagcggtcaatcgctttatgctgctgttgtctacactatattctcttgacgcccaggcgtttgccgaagcaacggaatcgttgcacggtcgtacacgcgtttactttgcggcagatgaacaaacgctgctgaaaaatggtaatcagaccaagccgaaacatgtgccaggcacgccgtattgggtgatcaccaacaccaacaccggccgtaaatgcagcatgatcgaacacatcatgcagtcgatgcaattcccggcggaattgattgagaaggtttgcggaactatctaacggctgaaattaatgaggtcatacccaaatggatagttcgtttacgcccattgaacaaatgctaaaatttcgcgccagccgccacgaagattttccttatcaggagatccttctgactcgtctttgcatgcacatgcaaagcaagctgctggagaaccgcaataaaatgctgaaggctcagggaattaacgagacgttgtttatggcgttgattacgctggagtctcaggaaaaccacagtattcagccttctgaattaagttgtgctcttggatcatcccgtaccaacgcgacgcgtattgccgatgaactggaaaaacgcggttggatcgaacgtcgtgaaagcgataacgatcgccgctgcctgcatctgcaattaacggaaaaaggtcacgagtttttgcgcgaggttttaccaccgcagcataactgcctgcatcaactctggtccgcgctcagcacaacagaaaaagatcagctcgagcaaatcacccgcaaattgctctcccgtctcgaccagatggaacaagacggtgtggttctcgaagcgatgagctaataatacaaaaattaggaggaatttcaacatgacaaatttatctgacatcattgaaaaagaaacaggaaaacaactagtgattcaagaatcaattctaatgttaccagaagaagtagaggaagtaattgggaataaaccagaaagtgatattttagttcatactgcttatgatgaaagtacagatgaaaatgtaatgctattaacttcagatgctccagaatataaaccttgggctttagtaattcaagacagtaatggagaaaataaaattaaaatgttataagtcgagattaagtaaaccggaatctgaagatgtcttctgaaaccggtccggttgcggttgacccgaccctgcgtcgtcgtatcgaaccgcacgaattcgaagttttcttcgacccgcgtgaactgcgtaaagaaacctgcctgctgtacgaaatcaactggggtggtcgtcactctatctggcgtcacacctctcagaacaccaacaaacacgttgaagttaacttcatcgaaaaattcaccaccgaacgttacttctgcccgaacacccgttgctctatcacctggttcctgtcttggtctccgtgcggtgaatgctctcgtgcgatcaccgaattcctgtctcgttacccgcacgttaccctgttcatctacatcgcgcgtctgtaccaccacgcggacccgcgtaaccgtcagggtctgcgtgacctgatctcttctggtgttaccatccagatcatgaccgaacaggaatctggttactgctggcgtaacttcgttaactactctccgtctaacgaagcgcactggccgcgttacccgcacctgtgggttcgtctgtacgttctggaactgtactgcatcatcctgggtctgccgccgtgcctgaacatcctgcgtcgtaaacagccgcagctgaccttcttcaccatcgcgctgcagtcttgccactaccagcgtctgccgccgcacatcctgtgggcgaccggtctgaaataaacttaattaacggcactcctcagccaagtcaaaagcctccgaccggaggcttttgactacatgcccatggcgtttacgccccgccctgccactcatcgcagtactgttgtaattcattaagcattctgccgacatggaagccatcacaaacggcatgatgaacctgaatcgccagcggcatcagcaccttgtcgccttgcgtataatatttgcccatagtgaaaacgggggcgaagaagttgtccatattggccacgtttaaatcaaaactggtgaaactcacccagggattggctgagacgaaaaacatattctcaataaaccctttagggaaataggccaggttttcaccgtaacacgccacatcttgcgaatatatgtgtagaaactgccggaaatcgtcgtggtattcactccagagcgatgaaaacgtttcagtttgctcatggaaaacggtgtaacaagggtgaacactatcccatatcaccagctcaccgtctttcattgccatacggaactccggatgagcattcatcaggcgggcaagaatgtgaataaaggccggataaaacttgtgcttatttttctttacggtctttaaaaaggccgtaatatccagctgaacggtctggttataggtacattgagtaactgactgaaatgcctcaaaatgttctttacgatgccattgggatatatcaacggtggtatatccagtgatttttttctccattttagcttccttagctcctgaaaatctcgataactcaaaaaatacgcccggtagtgatcttatttcattatggtgaaagttggaacctcttacgtgccaagccaaataggccgt

SEQ ID NO: 88 - DNA, 5943 bp, Artificial Sequence
  Synthetic Polynucleotide
cactcggtcgctacgctccgggcgtgagactgcggcgggcgctgcggacacatacaaagttacccacagattccgtggataagcaggggactaacatgtgaggcaaaacagcagggccgcgccggtggcgtttttccataggctccgccctcctgccagagttcacataaacagacgcttttccggtgcatctgtgggagccgtgaggctcaaccatgaatctgacagtacgggcgaaacccgacaggacttaaagatccccaccgtttccggcgggtcgctccctcttgcgctctcctgttccgaccctgccgtttaccggatacctgttccgcctttctcccttacgggaagtgtggcgctttctcatagctcacacactggtatctcggctcggtgtaggtcgttcgctccaagctgggctgtaagcaagaactccccgttcagcccgactgctgcgccttatccggtaactgttcacttgagtccaacccggaaaagcacggtaaaacgccactggcagcagccattggtaactgggagttcgcagaggatttgtttagctaaacacgcggttgctcttgaagtgtgcgccaaagtccggctacactggaaggacagatttggttgctgtgctctgcgaaagccagttaccacggttaagcagttccccaactgacttaaccttcgatcaaaccacctccccaggtggttttttcgtttacagggcaaaagattacgcgcagaaaaaaaggatctcaagaagatcctttgatcttttctactgaaccgctctagatttcagtgcaatttatctcttcaaatgtagcacctgaagtcagcccaggaggaagaggacatccggtcaaataaaacgaaaggctcagtcgaaagactgggcctttcgttttagacttagggaccctttatgacaacttgacggctacatcattcactttttcttcacaaccggcacggaactcgctcgggctggccccggtgcattttttaaatacccgcgagaaatagagttgatcgtcaaaaccaacattgcgaccgacggtggcgataggcatccgggtggtgctcaaaagcagcttcgcctggctgatacgttggtcctcgcgccagcttaagacgctaatccctaactgctggcggaaaagatgtgacagacgcgacggcgacaagcaaacatgctgtgcgacgctggcgatatcaaaattgctgtctgccaggtgatcgctgatgtactgacaagcctcgcgtacccgattatccatcggtggatggagcgactcgttaatcgcttccatgcgccgcagtaacaattgctcaagcagatttatcgccagcagctccgaatagcgcccttccccttgcccggcgttaatgatttgcccaaacaggtcgctgaaatgcggctggtgcgcttcatccgggcgaaagaaccccgtattggcaaatattgacggccagttaagccattcatgccagtaggcgcgcggacgaaagtaaacccactggtgataccattcgcgagcctccggatgacgaccgtagtgatgaatctctcctggcgggaacagcaaaatatcacccggtcggcaaacaaattctcgtccctgatttttcaccaccccctgaccgcgaatggtgagattgagaatataacctttcattcccagcggtcggtcgataaaaaaatcgagataaccgttggcctcaatcggcgttaaacccgccaccagatgggcattaaacgagtatcccggcagcaggggatcattttgcgcttcagccatacttttcatactcccaccattcagagaagaaaccaattgtccatattgcatcagacattgccgtcactgcgtcttttactggctcttctcgctaacccaaccggtaaccccgcttattaaaagcattctgtaacaaagcgggaccaaagccatgacaaaaacgcgtaacaaaagtgtctataatcacggcagaaaagtccacattgattatttgcacggcgtcacactttgctatgccatagcatttttatccataagattagcggatcctacctgacgctttttatcgcaactctctactgtttctccatacccgtttttttggacgcgtacaactcaagtctgacataaatgaccgctatgagcactgcaattacacgccagatcgttctcgctaccgcaaccaccggtatgaaccagattggtgcgcactatgaaggccacaagatcattgagattggtgccgttgaagtggtgaaccgtcgcctgacgggcaataacttccatgtttatctcaaacccgatcggctggtggatccggaagcctttggcgtacatggtattgccgatgaatttttgctcgataagcccacgtttgccgaagtagccgatgagttcatggactatattcgcggcgcggagttggtgatccataacgcagcgttcgatatcggctttatggactacgagttttcgttgcttaagcgcgatattccgaagaccaatactttctgtaaggtcaccgatagccttgcggtggcgaggaaaatgtttcccggtaagcgcaacagcctcgatgcgttatgtgctcgctacgaaatagataacagtaaacgaacgctgcacggggcattactcgatgcccagatccttgcggaagtttatctggcgatgaccggtggtcaaacgtcgatggcttttgcgatggaaggagagacacaacagcaacaaggtgaagcaacaattcagcgcattgtacgtcaggcaagtaagttacgcgttgtttttgcgacagatgaagagattgcagctcatgaagcccgtctcgatctggtgcagaagaaaggcggaagttgcctctggcgagcataatttaatatcagtaaaccggacataacccatgaagaaaaatcgcgcttttttgaagtgggcagggggcaagtatcccctgcttgatgatattaaacggcatttgcccaagggcgaatgtctggttgagccttttgtaggtgccgggtcggtgtttctcaacaccgacttttctcgttatatccttgccgatatcaatagcgacctgatcagtctctataacattgtgaagatgcgtactgatgagtacgtacaggccgcacgcgagctgtttgttcccgaaacaaattgcgccgaggtttactatcagttccgcgaagagttcaacaaaagccaggatccgttccgtcgggcggtactgtttttatatttgaaccgctacggttacaacggcctgtgtcgttacaatctgcgcggtgagtttaacgtgccgttcggccgctacaaaaaaccctatttcccggaagcagagttgtatcacttcgctgaaaaagcgcagaatgcctttttctattgtgagtcttacgccgatagcatggcgcgcgcagatgatgcatccgtcgtctattgcgatccgccttatgcaccgctgtctgcgaccgccaactttacggcgtatcacacaaacagttttacgcttgaacaacaagcgcatctggcggagatcgccgaaggtctggttgagcgccatattccagtgctgatctccaatcacgatacgatgttaacgcgtgagtggtatcagcgcgcaaaattgcatgtcgtcaaagttcgacgcagtataagcagcaacggcggcacacgtaaaaaggtggacgaactgctggctttgtacaaaccaggagtcgtttcacccgcgaaaaaataattcagctaagacactgcactggattaagatgaaaacgattgaagttgatgatgaactctacagctatattgccagccacactaagcatatcggcgagagcgcatccgacattttacggcgtatgttgaaattttccgccgcatcacagcctgctgctccggtgacgaaagaggttcgcgttgcgtcacctgctatcgtcgaagcgaagccggtcaaaacgattaaagacaaggttcgcgcaatgcgtgaacttctgctttcggatgaatacgcagagcaaaagcgagcggtcaatcgctttatgctgctgttgtctacactatattctcttgacgcccaggcgtttgccgaagcaacggaatcgttgcacggtcgtacacgcgtttactttgcggcagatgaacaaacgctgctgaaaaatggtaatcagaccaagccgaaacatgtgccaggcacgccgtattgggtgatcaccaacaccaacaccggccgtaaatgcagcatgatcgaacacatcatgcagtcgatgcaattcccggcggaattgattgagaaggtttgcggaactatctaacgtggggagacgacgcggatttttaactatgcgtatcccccgcatttatcatcctgaaccactgaccagccattctcacatcgcgctttgcgaagatgccgccaaccatatcgggcgcgtactgcgcatggggccggggcaggcgttgcaattgtttgacggtagcaaccaggtctttgacgccgaaattaccagcgccagcaaaaaaagcgtggaagtgaaggtgctggaaggccagatcgacgatcgcgaatctccgctgcatattcacctcggtcaggtgatgtcgcgtggtgaaaaaatggaatttactatccagaaatcgatcgaactcggtgtaagcctcattacgccacttttttctgagcgctgcggcgttaaactggatagtgaacgtctgaacaagaagcttcagcagtggcagaagattgcaattgctgcctgtgagcagtgtggtcgtaaccgggtgccggaaatccgtccagcgatggatctggaagcctggtgtgcagagcaggatgaaggactgaaactgaatcttcacccgcgcgccagtaacagcatcaatacgttgccgttaccggttgaacgcgtccgcctgctgattggcccggaaggcggtttatcggcagatgaaattgccatgactgcccgctatcaatttactgatatcctgttgggacctcgcgttttgcgtacagagacaactgcgctcaccgccattaccgcgctacaagtacgatttggcgatttgggctaaacttaattaacggcactcctcagccaagtcaaaagcctccgaccggaggcttttgactacatgcccatggcgtttacgccccgccctgccactcatcgcagtactgttgtaattcattaagcattctgccgacatggaagccatcacaaacggcatgatgaacctgaatcgccagcggcatcagcaccttgtcgccttgcgtataatatttgcccatagtgaaaacgggggcgaagaagttgtccatattggccacgtttaaatcaaaactggtgaaactcacccagggattggctgagacgaaaaacatattctcaataaaccctttagggaaataggccaggttttcaccgtaacacgccacatcttgcgaatatatgtgtagaaactgccggaaatcgtcgtggtattcactccagagcgatgaaaacgtttcagtttgctcatggaaaacggtgtaacaagggtgaacactatcccatatcaccagctcaccgtctttcattgccatacggaactccggatgagcattcatcaggcgggcaagaatgtgaataaaggccggataaaacttgtgcttatttttctttacggtctttaaaaaggccgtaatatccagctgaacggtctggttataggtacattgagtaactgactgaaatgcctcaaaatgttctttacgatgccattgggatatatcaacggtggtatatccagtgatttttttctccattttagcttccttagctcctgaaaatctcgataactcaaaaaatacgcccggtagtgatcttatttcattatggtgaaagttggaacctcttacgtgccaagccaaataggccgt

SEQ ID NO: 89 - DNA, 8861 bp, Artificial Sequence
  Synthetic Polynucleotide
cactcggtcgctacgctccgggcgtgagactgcggcgggcgctgcggacacatacaaagttacccacagattccgtggataagcaggggactaacatgtgaggcaaaacagcagggccgcgccggtggcgtttttccataggctccgccctcctgccagagttcacataaacagacgcttttccggtgcatctgtgggagccgtgaggctcaaccatgaatctgacagtacgggcgaaacccgacaggacttaaagatccccaccgtttccggcgggtcgctccctcttgcgctctcctgttccgaccctgccgtttaccggatacctgttccgcctttctcccttacgggaagtgtggcgctttctcatagctcacacactggtatctcggctcggtgtaggtcgttcgctccaagctgggctgtaagcaagaactccccgttcagcccgactgctgcgccttatccggtaactgttcacttgagtccaacccggaaaagcacggtaaaacgccactggcagcagccattggtaactgggagttcgcagaggatttgtttagctaaacacgcggttgctcttgaagtgtgcgccaaagtccggctacactggaaggacagatttggttgctgtgctctgcgaaagccagttaccacggttaagcagttccccaactgacttaaccttcgatcaaaccacctccccaggtggttttttcgtttacagggcaaaagattacgcgcagaaaaaaaggatctcaagaagatcctttgatcttttctactgaaccgctctagatttcagtgcaatttatctcttcaaatgtagcacctgaagtcagcccaggaggaagaggacatccggtcaaataaaacgaaaggctcagtcgaaagactgggcctttcgttttagacttagggaccctttatgacaacttgacggctacatcattcactttttcttcacaaccggcacggaactcgctcgggctggccccggtgcattttttaaatacccgcgagaaatagagttgatcgtcaaaaccaacattgcgaccgacggtggcgataggcatccgggtggtgctcaaaagcagcttcgcctggctgatacgttggtcctcgcgccagcttaagacgctaatccctaactgctggcggaaaagatgtgacagacgcgacggcgacaagcaaacatgctgtgcgacgctggcgatatcaaaattgctgtctgccaggtgatcgctgatgtactgacaagcctcgcgtacccgattatccatcggtggatggagcgactcgttaatcgcttccatgcgccgcagtaacaattgctcaagcagatttatcgccagcagctccgaatagcgcccttccccttgcccggcgttaatgatttgcccaaacaggtcgctgaaatgcggctggtgcgcttcatccgggcgaaagaaccccgtattggcaaatattgacggccagttaagccattcatgccagtaggcgcgcggacgaaagtaaacccactggtgataccattcgcgagcctccggatgacgaccgtagtgatgaatctctcctggcgggaacagcaaaatatcacccggtcggcaaacaaattctcgtccctgatttttcaccaccccctgaccgcgaatggtgagattgagaatataacctttcattcccagcggtcggtcgataaaaaaatcgagataaccgttggcctcaatcggcgttaaacccgccaccagatgggcattaaacgagtatcccggcagcaggggatcattttgcgcttcagccatacttttcatactcccaccattcagagaagaaaccaattgtccatattgcatcagacattgccgtcactgcgtcttttactggctcttctcgctaacccaaccggtaaccccgcttattaaaagcattctgtaacaaagcgggaccaaagccatgacaaaaacgcgtaacaaaagtgtctataatcacggcagaaaagtccacattgattatttgcacggcgtcacactttgctatgccatagcatttttatccataagattagcggatcctacctgacgctttttatcgcaactctctactgtttctccatacccgtttttttggacgcgtacaactcaagtctgacataaatgaccgctatgagcactgcaattacacgccagatcgttctcgctaccgcaaccaccggtatgaaccagattggtgcgcactatgaaggccacaagatcattgagattggtgccgttgaagtggtgaaccgtcgcctgacgggcaataacttccatgtttatctcaaacccgatcggctggtggatccggaagcctttggcgtacatggtattgccgatgaatttttgctcgataagcccacgtttgccgaagtagccgatgagttcatggactatattcgcggcgcggagttggtgatccataacgcagcgttcgatatcggctttatggactacgagttttcgttgcttaagcgcgatattccgaagaccaatactttctgtaaggtcaccgatagccttgcggtggcgaggaaaatgtttcccggtaagcgcaacagcctcgatgcgttatgtgctcgctacgaaatagataacagtaaacgaacgctgcacggggcattactcgatgcccagatccttgcggaagtttatctggcgatgaccggtggtcaaacgtcgatggcttttgcgatggaaggagagacacaacagcaacaaggtgaagcaacaattcagcgcattgtacgtcaggcaagtaagttacgcgttgtttttgcgacagatgaagagattgcagctcatgaagcccgtctcgatctggtgcagaagaaaggcggaagttgcctctggcgagcataatttaatatcagtaaaccggacataacccatgaagaaaaatcgcgcttttttgaagtgggcagggggcaagtatcccctgcttgatgatattaaacggcatttgcccaagggcgaatgtctggttgagccttttgtaggtgccgggtcggtgtttctcaacaccgacttttctcgttatatccttgccgatatcaatagcgacctgatcagtctctataacattgtgaagatgcgtactgatgagtacgtacaggccgcacgcgagctgtttgttcccgaaacaaattgcgccgaggtttactatcagttccgcgaagagttcaacaaaagccaggatccgttccgtcgggcggtactgtttttatatttgaaccgctacggttacaacggcctgtgtcgttacaatctgcgcggtgagtttaacgtgccgttcggccgctacaaaaaaccctatttcccggaagcagagttgtatcacttcgctgaaaaagcgcagaatgcctttttctattgtgagtcttacgccgatagcatggcgcgcgcagatgatgcatccgtcgtctattgcgatccgccttatgcaccgctgtctgcgaccgccaactttacggcgtatcacacaaacagttttacgcttgaacaacaagcgcatctggcggagatcgccgaaggtctggttgagcgccatattccagtgctgatctccaatcacgatacgatgttaacgcgtgagtggtatcagcgcgcaaaattgcatgtcgtcaaagttcgacgcagtataagcagcaacggcggcacacgtaaaaaggtggacgaactgctggctttgtacaaaccaggagtcgtttcacccgcgaaaaaataattcagctaagacactgcactggattaagatgaaaacgattgaagttgatgatgaactctacagctatattgccagccacactaagcatatcggcgagagcgcatccgacattttacggcgtatgttgaaattttccgccgcatcacagcctgctgctccggtgacgaaagaggttcgcgttgcgtcacctgctatcgtcgaagcgaagccggtcaaaacgattaaagacaaggttcgcgcaatgcgtgaacttctgctttcggatgaatacgcagagcaaaagcgagcggtcaatcgctttatgctgctgttgtctacactatattctcttgacgcccaggcgtttgccgaagcaacggaatcgttgcacggtcgtacacgcgtttactttgcggcagatgaacaaacgctgctgaaaaatggtaatcagaccaagccgaaacatgtgccaggcacgccgtattgggtgatcaccaacaccaacaccggccgtaaatgcagcatgatcgaacacatcatgcagtcgatgcaattcccggcggaattgattgagaaggtttgcggaactatctaaaagaattccaaaaacaggtacgacatacatgaatcagaatctgctggtgacaaagcgcgacggtagcacagagcgcatcaatctcgacaaaatccatcgcgttctggattgggcggcagaaggactgcataacgtttcgatttcccaggtcgagctgcgctcccacattcagttttatgacggtatcaagacctctgacatccacgaaaccattatcaaggttgccgcagacctgatctcccgtgatgcgccggattatcagtatctcgccgcgcgcctggcgatcttccacctgcgtaaaaaagcctacggccagtttgagccgcctgcgctgtacgaccacgtggtgaaaatggtcgagatgggcaaatacgataatcatctgctggaagactacacggaagaagagttcaagcagatggacacctttatcgatcacgaccgtgatatgaccttctcttatgctgccgttaagcagctggaaggcaaatatctggtacagaaccgcgtgaccggcgaaatctatgagagcgcccagttcctttatattctagttgccgcgtgcttgttctcgaactacccgcgtgaaacgcgcctgcaatatgtgaagcgtttttacgacgcggtttccacatttaaaatttcgctgccgacgccaatcatgtccggcgtgcgtaccccgactcgtcagttcagctcctgcgtactgatcgagtgcggtgacagcctggattccatcaacgccacctccagcgcgattgttaaatacgtttcccagcgtgccgggatcggcatcaacgccgggcgtattcgtgcgctgggtagcccgattcgcggtggtgaagcgttccataccggctgcattccgttctacaaacatttccagacagcggtgaaatcctgctctcagggcggtgtgcgcggcggtgcggcaacgctgttctacccgatgtggcatctggaagtggaaagcctgctggtgttgaaaaacaaccgtggtgtggaaggcaaccgcgtgcgtcatatggactacggggtacaaatcaacaaactgatgtatacccgtctgctgaaaggtgaagatatcaccctgttcagcccgtccgacgtaccggggctgtacgacgcgttcttcgccgatcaggaagagtttgaacgtctgtataccaaatatgagaaagacgacagcatccgcaagcagcgtgtgaaagccgttgagctgttctcgctgatgatgcaggaacgtgcgtctaccggtcgtatctatattcagaacgttgaccactgcaatacccatagcccgtttgatccggccatcgcgccagtgcgtcagtctaacctgtgcctggagatagccctgccgaccaaaccgctgaacgacgtcaacgacgagaacggtgaaatcgcgctgtgtacgctgtctgctttcaacctgggcgcaattaataacctggatgaactggaagagctggcaattctggcggttcgtgcacttgacgcgctgctggattatcaggattacccgatcccggccgccaaacgtggagcgatgggtcgtcgtacgctgggtattggtgtgatcaacttcgcttactacctggcgaagcacggtaaacgctactccgacggcagcgccaacaacctgacgcataaaaccttcgaagccattcagtattacctgctgaaagcctctaatgagctggcgaaagagcaaggcgcgtgcccgtggtttaacgaaaccacttacgcgaaagggatcctgccgatcgatacctataagaaagatctggataccatcgctaatgagccgctgcattacgactgggaagctctgcgtgagtcaatcaaaacgcacggtctgcgtaactccacgctttctgctctgatgccgtccgagacttcttcgcagatctctaacgccactaacggtattgaaccgccgcgcggttacgtcagcatcaaagcgtcgaaagacggtattttgcgccaggtggtgccggactacgagcacctgcacgacgcctatgagctgctgtgggaaatgccgggtaacgatggttatctgcaactggtgggtatcatgcagaaatttatcgatcagtcgatctctgccaacaccaactacgatccgtcacgcttcccgtcaggaaaagtgccgatgcagcagttgctgaaagacctgctcaccgcctacaaattcggggtcaaaacactgtattatcagaacacccgtgacggcgctgaagacgcacaagacgatctggtgccgtcaatccaggacgatggctgcgaaagcggcgcatgtaagatctgatattgagatgccggatgcggcgtaaacgccttatccggcctacggctcggtttgtaggcctgataagacgcgccagcgtcgcatcaggctccgggtgccggatgcagcgtgaacgccttatccggcctacggctcggatttgtaggcctgataagacgcgccagcgtcgcatcaggcacaggatgcggcgtaaaatgccttatccggcattaaactcccaacaggacacactcatggcatataccaccttttcacagacgaaaaatgatcagctcaaagaaccgatgttctttggtcagccggtcaacgtggctcgctacgatcagcaaaaatatgacatcttcgaaaagctgatcgaaaagcagctctctttcttctggcgtccggaagaagttgacgtctcccgcgaccgtatagattaccaggcgctgccggagcacgaaaaacacatctttatcagcaacctgaaatatcagacgctgctggattccattcagggtcgtagcccgaacgtggcgctattgccgcttatttctattccggaactggaaacctgggtcgaaacctgggcgttctcagaaacgattcattcccgttcctatactcatatcattcgtaatatcgttaacgatccgtctgttgtgtttgacgatatcgtcaccaacgagcagatccagaaacgtgcggaagggatctccagctattacgatgagctgatcgaaatgaccagctactggcatctgctgggcgaaggtacccacaccgttaacggtaaaactgtgaccgttagcctgcgcgagctgaagaaaaaactgtatctctgcctgatgagcgttaacgcgctggaagcgattcgtttctacgtcagctttgcttgttccttcgcatttgcagaacgcgaattgatggaaggcaacgccaaaattattcgcctgattgcccgcgacgaagccctgcacctgaccggcacccagcatatgctgaatctgctgcgcagcggcgcggacgatcctgagatggcggaaattgccgaagagtgtaagcaggagtgctatgacctgtttgttcaggcagctcaacaggagaaagactgggcggattatctgttccgcgacggttcgatgattggtctgaataaagacattctctgccagtacgttgaatacatcaccaatatccgtatgcaggcagtcggtttggatctgccgttccagacgcgctccaacccgatcccgtggatcaacacttggctggtgtctgataacgtgcaggttgctccgcaggaagtggaagtcagttcttatctggtcgggcagattgactcggaagtggacaccgacgatttgagtaacttccagctctgaacttaattaacggcactcctcagccaagtcaaaagcctccgaccggaggcttttgactacatgcccatggcgtttacgccccgccctgccactcatcgcagtactgttgtaattcattaagcattctgccgacatggaagccatcacaaacggcatgatgaacctgaatcgccagcggcatcagcaccttgtcgccttgcgtataatatttgcccatagtgaaaacgggggcgaagaagttgtccatattggccacgtttaaatcaaaactggtgaaactcacccagggattggctgagacgaaaaacatattctcaataaaccctttagggaaataggccaggttttcaccgtaacacgccacatcttgcgaatatatgtgtagaaactgccggaaatcgtcgtggtattcactccagagcgatgaaaacgtttcagtttgctcatggaaaacggtgtaacaagggtgaacactatcccatatcaccagctcaccgtctttcattgccatacggaactctggatgagcattcatcaggcgggcaagaatgtgaataaaggccggataaaacttgtgcttatttttctttacggtctttaaaaaggccgtaatatccagctgaacggtctggttataggtacattgagtaactgactgaaatgcctcaaaatgttctttacgatgccattgggatatatcaacggtggtatatccagtgatttttttctccattttagcttccttagctcctgaaaatctcgataactcaaaaaatacgcccggtagtgatcttatttcattatggtgaaagttggaacctcttacgtgccaagccaaataggccgt

SEQ ID NO: 90 - DNA, 8861 bp, Artificial Sequence
  Synthetic Polynucleotide
cactcggtcgctacgctccgggcgtgagactgcggcgggcgctgcggacacatacaaagttacccacagattccgtggataagcaggggactaacatgtgaggcaaaacagcagggccgcgccggtggcgtttttccataggctccgccctcctgccagagttcacataaacagacgcttttccggtgcatctgtgggagccgtgaggctcaaccatgaatctgacagtacgggcgaaacccgacaggacttaaagatccccaccgtttccggcgggtcgctccctcttgcgctctcctgttccgaccctgccgtttaccggatacctgttccgcctttctcccttacgggaagtgtggcgctttctcatagctcacacactggtatctcggctcggtgtaggtcgttcgctccaagctgggctgtaagcaagaactccccgttcagcccgactgctgcgccttatccggtaactgttcacttgagtccaacccggaaaagcacggtaaaacgccactggcagcagccattggtaactgggagttcgcagaggatttgtttagctaaacacgcggttgctcttgaagtgtgcgccaaagtccggctacactggaaggacagatttggttgctgtgctctgcgaaagccagttaccacggttaagcagttccccaactgacttaaccttcgatcaaaccacctccccaggtggttttttcgtttacagggcaaaagattacgcgcagaaaaaaaggatctcaagaagatcctttgatcttttctactgaaccgctctagatttcagtgcaatttatctcttcaaatgtagcacctgaagtcagcccaggaggaagaggacatccggtcaaataaaacgaaaggctcagtcgaaagactgggcctttcgttttagacttagggaccctttatgacaacttgacggctacatcattcactttttcttcacaaccggcacggaactcgctcgggctggccccggtgcattttttaaatacccgcgagaaatagagttgatcgtcaaaaccaacattgcgaccgacggtggcgataggcatccgggtggtgctcaaaagcagcttcgcctggctgatacgttggtcctcgcgccagcttaagacgctaatccctaactgctggcggaaaagatgtgacagacgcgacggcgacaagcaaacatgctgtgcgacgctggcgatatcaaaattgctgtctgccaggtgatcgctgatgtactgacaagcctcgcgtacccgattatccatcggtggatggagcgactcgttaatcgcttccatgcgccgcagtaacaattgctcaagcagatttatcgccagcagctccgaatagcgcccttccccttgcccggcgttaatgatttgcccaaacaggtcgctgaaatgcggctggtgcgcttcatccgggcgaaagaaccccgtattggcaaatattgacggccagttaagccattcatgccagtaggcgcgcggacgaaagtaaacccactggtgataccattcgcgagcctccggatgacgaccgtagtgatgaatctctcctggcgggaacagcaaaatatcacccggtcggcaaacaaattctcgtccctgatttttcaccaccccctgaccgcgaatggtgagattgagaatataacctttcattcccagcggtcggtcgataaaaaaatcgagataaccgttggcctcaatcggcgttaaacccgccaccagatgggcattaaacgagtatcccggcagcaggggatcattttgcgcttcagccatacttttcatactcccaccattcagagaagaaaccaattgtccatattgcatcagacattgccgtcactgcgtcttttactggctcttctcgctaacccaaccggtaaccccgcttattaaaagcattctgtaacaaagcgggaccaaagccatgacaaaaacgcgtaacaaaagtgtctataatcacggcagaaaagtccacattgattatttgcacggcgtcacactttgctatgccatagcatttttatccataagattagcggatcctacctgacgctttttatcgcaactctctactgtttctccatacccgtttttttggacgcgtacaactcaagtctgacataaatgaccgctatgagcactgcaattacacgccagatcgttctcgctaccgcaaccaccggtatgaaccagattggtgcgcactatgaaggccacaagatcattgagattggtgccgttgaagtggtgaaccgtcgcctgacgggcaataacttccatgtttatctcaaacccgatcggctggtggatccggaagcctttggcgtacatggtattgccgatgaatttttgctcgataagcccacgtttgccgaagtagccgatgagttcatggactatattcgcggcgcggagttggtgatccataacgcagcgttcgatatcggctttatggactacgagttttcgttgcttaagcgcgatattccgaagaccaatactttctgtaaggtcaccgatagccttgcggtggcgaggaaaatgtttcccggtaagcgcaacagcctcgatgcgttatgtgctcgctacgaaatagataacagtaaacgaacgctgcacggggcattactcgatgcccagatccttgcggaagtttatctggcgatgaccggtggtcaaacgtcgatggcttttgcgatggaaggagagacacaacagcaacaaggtgaagcaacaattcagcgcattgtacgtcaggcaagtaagttacgcgttgtttttgcgacagatgaagagattgcagctcatgaagcccgtctcgatctggtgcagaagaaaggcggaagttgcctctggcgagcataatttaatatcagtaaaccggacataacccatgaagaaaaatcgcgcttttttgaagtgggcagggggcaagtatcccctgcttgatgatattaaacggcatttgcccaagggcgaatgtctggttgagccttttgtaggtgccgggtcggtgtttctcaacaccgacttttctcgttatatccttgccgatatcaatagcgacctgatcagtctctataacattgtgaagatgcgtactgatgagtacgtacaggccgcacgcgagctgtttgttcccgaaacaaattgcgccgaggtttactatcagttccgcgaagagttcaacaaaagccaggatccgttccgtcgggcggtactgtttttatatttgaaccgctacggttacaacggcctgtgtcgttacaatctgcgcggtgagtttaacgtgccgttcggccgctacaaaaaaccctatttcccggaagcagagttgtatcacttcgctgaaaaagcgcagaatgcctttttctattgtgagtcttacgccgatagcatggcgcgcgcagatgatgcatccgtcgtctattgcgatccgccttatgcaccgctgtctgcgaccgccaactttacggcgtatcacacaaacagttttacgcttgaacaacaagcgcatctggcggagatcgccgaaggtctggttgagcgccatattccagtgctgatctccaatcacgatacgatgttaacgcgtgagtggtatcagcgcgcaaaattgcatgtcgtcaaagttcgacgcagtataagcagcaacggcggcacacgtaaaaaggtggacgaactgctggctttgtacaaaccaggagtcgtttcacccgcgaaaaaataattcagctaagacactgcactggattaagatgaaaacgattgaagttgatgatgaactctacagctatattgccagccacactaagcatatcggcgagagcgcatccgacattttacggcgtatgttgaaattttccgccgcatcacagcctgctgctccggtgacgaaagaggttcgcgttgcgtcacctgctatcgtcgaagcgaagccggtcaaaacgattaaagacaaggttcgcgcaatgcgtgaacttctgctttcggatgaatacgcagagcaaaagcgagcggtcaatcgctttatgctgctgttgtctacactatattctcttgacgcccaggcgtttgccgaagcaacggaatcgttgcacggtcgtacacgcgtttactttgcggcagatgaacaaacgctgctgaaaaatggtaatcagaccaagccgaaacatgtgccaggcacgccgtattgggtgatcaccaacaccaacaccggccgtaaatgcagcatgatcgaacacatcatgcagtcgatgcaattcccggcggaattgattgagaaggtttgcggaactatctaaaagaattccaaaaacaggtacgacatacatgaatcagaatctgctggtgacaaagcgcgacggtagcacagagcgcatcaatctcgacaaaatccatcgcgttctggattgggcggcagaaggactgcataacgtttcgatttcccaggtcgagctgcgctcccacattcagttttatgacggtatcaagacctctgacatccacgaaaccattatcaaggctgccgcagacctgatctcccgtgatgcgccggattatcagtatctcgccgcgcgcctggcgatcttccacctgcgtaaaaaagcctacggccagtttgagccgcctgcgctgtacgaccacgtggtgaaaatggtcgagatgggcaaatacgataatcatctgctggaagactacacggaagaagagttcaagcagatggacacctttatcgatcacgaccgtgatatgaccttctcttatgctgccgttaagcagctggaaggcaaatatctggtacagaaccgcgtgaccggcgaaatctatgagagcgcccagttcctttatattctagttgccgcgtgcttgttctcgaactacccgcgtgaaacgcgcctgcaatatgtgaagcgtttttacgacgcggtttccacatttaaaatttcgctgccgacgccaatcatgtccggcgtgcgtaccccgactcgtcagttcagctcctgcgtactgatcgagtgcggtgacagcctggattccatcaacgccacctccagcgcgattgttaaatacgtttcccagcgtgccgggatcggcatcaacgccgggcgtattcgtgcgctgggtagcccgattcgcggtggtgaagcgttccataccggctgcattccgttctacaaacatttccagacagcggtgaaatcctgctctcagggcggtgtgcgcggcggtgtggcaacgctgttctacccgatgtggcatctggaagtggaaagcctgctggtgttgaaaaacaaccgtggtgtggaaggcaaccgcgtgcgtcatatggactacggggtacaaatcaacaaactgatgtatacccgtctgctgaaaggtgaagatatcaccctgttcagcccgtccgacgtaccggggctgtacgacgcgttcttcgccgatcaggaagagtttgaacgtctgtataccaaatatgagaaagacgacagcatccgcaagcagcgtgtgaaagccgttgagctgttctcgctgatgatgcaggaacgtgcgtctaccggtcgtatctatattcagaacgttgaccactgcaatacccatagcccgtttgatccggccatcgcgccagtgcgtcagtctaacctgtgcctggagatagccctgccgaccaaaccgctgaacgacgtcaacgacgagaacggtgaaatcgcgctgtgtacgctgtctgctttcaacctgggcgcaattaataacctggatgaactggaagagctggcaattctggcggttcgtgcacttgacgcgctgctggattatcaggattacccgatcccggccgccaaacgtggagcgatgggtcgtcgtacgctgggtattggtgtgatcaacttcgcttactacctggcgaagcacggtaaacgctactccgacggcagcgccaacaacctgacgcataaaaccttcgaagccattcagtattacctgctgaaagcctctaatgagctggcgaaagagcaaggcgcgtgcccgtggtttaacgaaaccacttacgcgaaagggatcctgccgatcgatacctataagaaagatctggataccatcgctaatgagccgctgcattacgactgggaagctctgcgtgagtcaatcaaaacgcacggtctgcgtaactccacgctttctgctctgatgccgtccgagacttcttcgcagatctctaacgccactaacggtattgaaccgccgcgcggttacgtcagcatcaaagcgtcgaaagacggtattttgcgccaggtggtgccggactacgagcacctgcacgacgcctatgagctgctgtgggaaatgccgggtaacgatggttatctgcaactggtgggtatcatgcagaaatttatcgatcagtcgatctctgccaacaccaactacgatccgtcacgcttcccgtcaggaaaagtgccgatgcagcagttgctgaaagacctgctcaccgcctacaaattcggggtcaaaacactgtattatcagaacacccgtgacggcgctgaagacgcacaagacgatctggtgccgtcaatccaggacgatggctgcgaaagcggcgcatgtaagatctgatattgagatgccggatgcggcgtaaacgccttatccggcctacggctcggtttgtaggcctgataagacgcgccagcgtcgcatcaggctccgggtgccggatgcagcgtgaacgccttatccggcctacggctcggatttgtaggcctgataagacgcgccagcgtcgcatcaggcacaggatgcggcgtaaaatgccttatccggcattaaactcccaacaggacacactcatggcatataccaccttttcacagacgaaaaatgatcagctcaaagaaccgatgttctttggtcagccggtcaacgtggctcgctacgatcagcaaaaatatgacatcttcgaaaagctgatcgaaaagcagctctctttcttctggcgtccggaagaagttgacgtctcccgcgaccgtatagattaccaggcgctgccggagcacgaaaaacacatctttatcagcaacctgaaatatcagacgctgctggattccattcagggtcgtagcccgaacgtggcgctattgccgcttatttctattccggaactggaaacctgggtcgaaacctgggcgttctcagaaacgattcattcccgttcctatactcatatcattcgtaatatcgttaacgatccgtctgttgtgtttgacgatatcgtcaccaacgagcagatccagaaacgtgcggaagggatctccagctattacgatgagctgatcgaaatgaccagctactggcatctgctgggcgaaggtacccacaccgttaacggtaaaactgtgaccgttagcctgcgcgagctgaagaaaaaactgtatctctgcctgatgagcgttaacgcgctggaagcgattcgtttctacgtcagctttgcttgttccttcgcatttgcagaacgcgaattgatggaaggcaacgccaaaattattcgcctgattgcccgcgacgaagccctgcacctgaccggcacccagcatatgctgaatctgctgcgcagcggcgcggacgatcctgagatggcggaaattgccgaagagtgtaagcaggagtgctatgacctgtttgttcaggcagctcaacaggagaaagactgggcggattatctgttccgcgacggttcgatgattggtctgaataaagacattctctgccagtacgttgaatacatcaccaatatccgtatgcaggcagtcggtttggatctgccgttccagacgcgctccaacccgatcccgtggatcaacacttggctggtgtctgataacgtgcaggttgctccgcaggaagtggaagtcagttcttatctggtcgggcagattgactcggaagtggacaccgacgatttgagtaacttccagctctgaacttaattaacggcactcctcagccaagtcaaaagcctccgaccggaggcttttgactacatgcccatggcgtttacgccccgccctgccactcatcgcagtactgttgtaattcattaagcattctgccgacatggaagccatcacaaacggcatgatgaacctgaatcgccagcggcatcagcaccttgtcgccttgcgtataatatttgcccatagtgaaaacgggggcgaagaagttgtccatattggccacgtttaaatcaaaactggtgaaactcacccagggattggctgagacgaaaaacatattctcaataaaccctttagggaaataggccaggttttcaccgtaacacgccacatcttgcgaatatatgtgtagaaactgccggaaatcgtcgtggtattcactccagagcgatgaaaacgtttcagtttgctcatggaaaacggtgtaacaagggtgaacactatcccatatcaccagctcaccgtctttcattgccatacggaactccggatgagcattcatcaggcgggcaagaatgtgaataaaggccggataaaacttgtgcttatttttctttacggtctttaaaaaggccgtaatatccagctgaacggtctggttataggtacattgagtaactgactgaaatgcctcaaaatgttctttacgatgccattgggatatatcaacggtggtatatccagtgatttttttctccattttagcttccttagctcctgaaaatctcgataactcaaaaaatacgcccggtagtgatcttatttcattatggtgaaagttggaacctcttacgtgccaagccaaataggccgt

SEQ ID NO: 91 - DNA, 8861 bp, Artificial Sequence
  Synthetic Polynucleotide
cactcggtcgctacgctccgggcgtgagactgcggcgggcgctgcggacacatacaaagttacccacagattccgtggataagcaggggactaacatgtgaggcaaaacagcagggccgcgccggtggcgtttttccataggctccgccctcctgccagagttcacataaacagacgcttttccggtgcatctgtgggagccgtgaggctcaaccatgaatctgacagtacgggcgaaacccgacaggacttaaagatccccaccgtttccggcgggtcgctccctcttgcgctctcctgttccgaccctgccgtttaccggatacctgttccgcctttctcccttacgggaagtgtggcgctttctcatagctcacacactggtatctcggctcggtgtaggtcgttcgctccaagctgggctgtaagcaagaactccccgttcagcccgactgctgcgccttatccggtaactgttcacttgagtccaacccggaaaagcacggtaaaacgccactggcagcagccattggtaactgggagttcgcagaggatttgtttagctaaacacgcggttgctcttgaagtgtgcgccaaagtccggctacactggaaggacagatttggttgctgtgctctgcgaaagccagttaccacggttaagcagttccccaactgacttaaccttcgatcaaaccacctccccaggtggttttttcgtttacagggcaaaagattacgcgcagaaaaaaaggatctcaagaagatcctttgatcttttctactgaaccgctctagatttcagtgcaatttatctcttcaaatgtagcacctgaagtcagcccaggaggaagaggacatccggtcaaataaaacgaaaggctcagtcgaaagactgggcctttcgttttagacttagggaccctttatgacaacttgacggctacatcattcactttttcttcacaaccggcacggaactcgctcgggctggccccggtgcattttttaaatacccgcgagaaatagagttgatcgtcaaaaccaacattgcgaccgacggtggcgataggcatccgggtggtgctcaaaagcagcttcgcctggctgatacgttggtcctcgcgccagcttaagacgctaatccctaactgctggcggaaaagatgtgacagacgcgacggcgacaagcaaacatgctgtgcgacgctggcgatatcaaaattgctgtctgccaggtgatcgctgatgtactgacaagcctcgcgtacccgattatccatcggtggatggagcgactcgttaatcgcttccatgcgccgcagtaacaattgctcaagcagatttatcgccagcagctccgaatagcgcccttccccttgcccggcgttaatgatttgcccaaacaggtcgctgaaatgcggctggtgcgcttcatccgggcgaaagaaccccgtattggcaaatattgacggccagttaagccattcatgccagtaggcgcgcggacgaaagtaaacccactggtgataccattcgcgagcctccggatgacgaccgtagtgatgaatctctcctggcgggaacagcaaaatatcacccggtcggcaaacaaattctcgtccctgatttttcaccaccccctgaccgcgaatggtgagattgagaatataacctttcattcccagcggtcggtcgataaaaaaatcgagataaccgttggcctcaatcggcgttaaacccgccaccagatgggcattaaacgagtatcccggcagcaggggatcattttgcgcttcagccatacttttcatactcccaccattcagagaagaaaccaattgtccatattgcatcagacattgccgtcactgcgtcttttactggctcttctcgctaacccaaccggtaaccccgcttattaaaagcattctgtaacaaagcgggaccaaagccatgacaaaaacgcgtaacaaaagtgtctataatcacggcagaaaagtccacattgattatttgcacggcgtcacactttgctatgccatagcatttttatccataagattagcggatcctacctgacgctttttatcgcaactctctactgtttctccatacccgtttttttggacgcgtacaactcaagtctgacataaatgaccgctatgagcactgcaattacacgccagatcgttctcgctaccgcaaccaccggtatgaaccagattggtgcgcactatgaaggccacaagatcattgagattggtgccgttgaagtggtgaaccgtcgcctgacgggcaataacttccatgtttatctcaaacccgatcggctggtggatccggaagcctttggcgtacatggtattgccgatgaatttttgctcgataagcccacgtttgccgaagtagccgatgagttcatggactatattcgcggcgcggagttggtgatccataacgcagcgttcgatatcggctttatggactacgagttttcgttgcttaagcgcgatattccgaagaccaatactttctgtaaggtcaccgatagccttgcggtggcgaggaaaatgtttcccggtaagcgcaacagcctcgatgcgttatgtgctcgctacgaaatagataacagtaaacgaacgctgcacggggcattactcgatgcccagatccttgcggaagtttatctggcgatgaccggtggtcaaacgtcgatggcttttgcgatggaaggagagacacaacagcaacaaggtgaagcaacaattcagcgcattgtacgtcaggcaagtaagttacgcgttgtttttgcgacagatgaagagattgcagctcatgaagcccgtctcgatctggtgcagaagaaaggcggaagttgcctctggcgagcataatttaatatcagtaaaccggacataacccatgaagaaaaatcgcgcttttttgaagtgggcagggggcaagtatcccctgcttgatgatattaaacggcatttgcccaagggcgaatgtctggttgagccttttgtaggtgccgggtcggtgtttctcaacaccgacttttctcgttatatccttgccgatatcaatagcgacctgatcagtctctataacattgtgaagatgcgtactgatgagtacgtacaggccgcacgcgagctgtttgttcccgaaacaaattgcgccgaggtttactatcagttccgcgaagagttcaacaaaagccaggatccgttccgtcgggcggtactgtttttatatttgaaccgctacggttacaacggcctgtgtcgttacaatctgcgcggtgagtttaacgtgccgttcggccgctacaaaaaaccctatttcccggaagcagagttgtatcacttcgctgaaaaagcgcagaatgcctttttctattgtgagtcttacgccgatagcatggcgcgcgcagatgatgcatccgtcgtctattgcgatccgccttatgcaccgctgtctgcgaccgccaactttacggcgtatcacacaaacagttttacgcttgaacaacaagcgcatctggcggagatcgccgaaggtctggttgagcgccatattccagtgctgatctccaatcacgatacgatgttaacgcgtgagtggtatcagcgcgcaaaattgcatgtcgtcaaagttcgacgcagtataagcagcaacggcggcacacgtaaaaaggtggacgaactgctggctttgtacaaaccaggagtcgtttcacccgcgaaaaaataattcagctaagacactgcactggattaagatgaaaacgattgaagttgatgatgaactctacagctatattgccagccacactaagcatatcggcgagagcgcatccgacattttacggcgtatgttgaaattttccgccgcatcacagcctgctgctccggtgacgaaagaggttcgcgttgcgtcacctgctatcgtcgaagcgaagccggtcaaaacgattaaagacaaggttcgcgcaatgcgtgaacttctgctttcggatgaatacgcagagcaaaagcgagcggtcaatcgctttatgctgctgttgtctacactatattctcttgacgcccaggcgtttgccgaagcaacggaatcgttgcacggtcgtacacgcgtttactttgcggcagatgaacaaacgctgctgaaaaatggtaatcagaccaagccgaaacatgtgccaggcacgccgtattgggtgatcaccaacaccaacaccggccgtaaatgcagcatgatcgaacacatcatgcagtcgatgcaattcccggcggaattgattgagaaggtttgcggaactatctaaaagaattccaaaaacaggtacgacatacatgaatcagaatctgctggtgacaaagcgcgacggtagcacagagcgcatcaatctcgacaaaatccatcgcgttctggattgggcggcagaaggactgcataacgtttcgatttcccaggtcgagctgcgctcccacattcagttttatgacggtatcaagacctctgacatccacgaaaccattatcaaggctgccgcagacctgatctcccgtgatgcgccggattatcagtatctcgccgcgcgcctggcgatcttccacctgcgtaaaaaagcctacggccagtttgagccgcctgcgctgtacgaccacgtggtgaaaatggtcgagatgggcaaatacgataatcatctgctggaagactacacggaagaagagttcaagcagatggacacctttatcgatcacgaccgtgatatgaccttctcttatgctgccgttaagcagctggaaggcaaatatctggtacagaaccgcgtgaccggcgaaatctatgagagcgcccagttcctttatattctagttgccgcgtgcttgttctcgaactacccgcgtgaaacgcgcctgcaatatgtgaagcgtttttacgacgcggtttccacatttaaaatttcgctgccgacgccaatcatgtccggcgtgcgtaccccgactcgtcagttcagctcctgcgtactgatcgagtgcggtgacagcctggattccatcaacgccacctccagcgcgattgttaaatacgtttcccagcgtgccgggatcggcatcaacgccgggcgtattcgtgcgctgggtagcccgattcgcggtggtgaagcgttccataccggctgcattccgttctacaaacatttccagacagcggtgaaatcctgctctcagggcggtgtgcgcggcggtgcggcaacgctgttctacccgatgtggcatctggaagtggaaagcctgctggtgttgaaaaacaaccgtggtgtggaaggcaaccgcgtgcgtcatatggactacggggtacaaatcaacaaactgatgtatacccgtctgctgaaaggtgaagatatcaccctgttcagcccgtccgacgtaccggggctgtacgacgcgttcttcgccgatcaggaagagtttgaacgtctgtataccaaatatgagaaagacgacagcatccgcaagcagcgtgtgaaagccgttgagctgttctcgctgatgatgcaggaacgtgcgtctaccggtcgtatctatattcagaacgttgaccactgcaatacccatagcccgtttgatccggccatcgcgccagtgcgtcagtctaacctgtgcctggagatagccctgccgaccaaaccgctgaacgacgtcaacgacgagaacggtgaaatcgcgctgtgtacgctgtctgctttcaacctgggcgcaattaataacctggatgaactggaagagctggcaattctggcggttcgtgcacttgacgcgctgctggattatcaggattacccgatcccggccgccaaacgtggagcgatgggtcgtcgtacgctgggtattggtgtgatcaacttcgcttactacctggcgaagcacggtaaacgctactccgacggcagcgccaacaacctgacgcataaaaccttcgaagccattcagtattacctgctgaaagcctctaatgagctggcgaaagagcaaggcgcgtgcccgtggtttaacgaaaccacttacgcgaaagggatcctgccgatcgatacctataagaaagatctggataccatcgctaatgagccgctgcattacgactgggaagctctgcgtgagtcaatcaaaacgcacggtctgcgtaactccacgctttctgctctgatgccgtccgagacttcttcgcagatctctaacgccactaacggtattgaaccgccgcgcggttacgtcagcatcaaagcgtcgaaagacggtattttgcgccaggtggtgccggactacgagcacctgcacgacgcctatgagctgctgtgggaaatgccgggtaacgatggttatctgcaactggtgggtatcatgcagaaatttatcgatcagtcgatctctgccaacaccaactacgatccgtcacgcttcccgtcaggaaaagtgccgatgcagcagttgctgaaagacctgctcaccgcctacaaattcggggtcaaaacactgtattatcagaacacccgtgacggcgctgaagacgcacaagacgatctggtgccgtcaatccaggacgatggctgcgaaagcggcgcatgtaagatctgatattgagatgccggatgcggcgtaaacgccttatccggcctacggctcggtttgtaggcctgataagacgcgccagcgtcgcatcaggctccgggtgccggatgcagcgtgaacgccttatccggcctacggctcggatttgtaggcctgataagacgcgccagcgtcgcatcaggcacaggatgcggcgtaaaatgccttatccggcattaaactcccaacaggacacactcatggcatataccaccttttcacagacgaaaaatgatcagctcaaagaaccgatgttctttggtcagccggtcaacgtggctcgctacgatcagcaaaaatatgacatcttcgaaaagctgatcgaaaagcagctctctttcttctggcgtccggaagaagttgacgtctcccgcgaccgtatagattaccaggcgctgccggagcacgaaaaacacatctttatcagcaacctgaaatatcagacgctgctggattccattcagggtcgtagcccgaacgtggcgctattgccgcttatttctattccggaactggaaacctgggtcgaaacctgggcgttctcagaaacgattcattcccgttcctatactcatatcattcgtaatatcgttaacgatccgtctgttgtgtttgacgatatcgtcaccaacgagcagatccagaaacgtgcggaagggatctccagctattacgatgagctgatcgaaatgaccagctactggcatctgctgggcgaaggtacccacaccgttaacggtaaaactgtgaccgttagcctgcgcgagctgaagaaaaaactgtatctctgcctgatgagcgttaacgcgctggaagcgattcgtttctacgtcagctttgcttgttccttcgcatttgcagaacgcgaattgatggaaggcaacgccaaaattattcgcctgattgcccgcgacgaagccctgcacctgaccggcacccagcatatgctgaatctgctgcgcagcggcgcggacgatcctgagatggcggaaattgccgaagagtgtaagcaggagtgctatgacctgtttgttcaggcagctcaacaggagaaagactgggcggattatctgttccgcgacggttcgatgattggtctgaataaagacattctctgccagtacgttgaatacatcaccaatatccgtatgcaggcagtcggtttggatctgccgttccagacgcgctccaacccgatcctgtggatcaacacttggctggtgtctgataacgtgcaggttgctccgcaggaagtggaagtcagttcttatctggtcgggcagattgactcggaagtggacaccgacgatttgagtaacttccagctctgaacttaattaacggcactcctcagccaagtcaaaagcctccgaccggaggcttttgactacatgcccatggcgtttacgccccgccctgccactcatcgcagtactgttgtaattcattaagcattctgccgacatggaagccatcacaaacggcatgatgaacctgaatcgccagcggcatcagcaccttgtcgccttgcgtataatatttgcccatagtgaaaacgggggcgaagaagttgtccatattggccacgtttaaatcaaaactggtgaaactcacccagggattggctgagacgaaaaacatattctcaataaaccctttagggaaataggccaggttttcaccgtaacacgccacatcttgcgaatatatgtgtagaaactgccggaaatcgtcgtggtattcactccagagcgatgaaaacgtttcagtttgctcatggaaaacggtgtaacaagggtgaacactatcccatatcaccagctcaccgtctttcattgccatacggaactccggatgagcattcatcaggcgggcaagaatgtgaataaaggccggataaaacttgtgcttatttttctttacggtctttaaaaaggccgtaatatccagctgaacggtctggttataggtacattgagtaactgactgaaatgcctcaaaatgttctttacgatgccattgggatatatcaacggtggtatatccagtgatttttttctccattttagcttccttagctcctgaaaatctcgataactcaaaaaatacgcccggtagtgatcttatttcattatggtgaaagttggaacctcttacgtgccaagccaaataggccgt

SEQ ID NO: 92 - DNA, 8325 bp, Artificial Sequence
  Synthetic Polynucleotide
cactcggtcgctacgctccgggcgtgagactgcggcgggcgctgcggacacatacaaagttacccacagattccgtggataagcaggggactaacatgtgaggcaaaacagcagggccgcgccggtggcgtttttccataggctccgccctcctgccagagttcacataaacagacgcttttccggtgcatctgtgggagccgtgaggctcaaccatgaatctgacagtacgggcgaaacccgacaggacttaaagatccccaccgtttccggcgggtcgctccctcttgcgctctcctgttccgaccctgccgtttaccggatacctgttccgcctttctcccttacgggaagtgtggcgctttctcatagctcacacactggtatctcggctcggtgtaggtcgttcgctccaagctgggctgtaagcaagaactccccgttcagcccgactgctgcgccttatccggtaactgttcacttgagtccaacccggaaaagcacggtaaaacgccactggcagcagccattggtaactgggagttcgcagaggatttgtttagctaaacacgcggttgctcttgaagtgtgcgccaaagtccggctacactggaaggacagatttggttgctgtgctctgcgaaagccagttaccacggttaagcagttccccaactgacttaaccttcgatcaaaccacctccccaggtggttttttcgtttacagggcaaaagattacgcgcagaaaaaaaggatctcaagaagatcctttgatcttttctactgaaccgctctagatttcagtgcaatttatctcttcaaatgtagcacctgaagtcagcccaggaggaagaggacatccggtcaaataaaacgaaaggctcagtcgaaagactgggcctttcgttttagacttagggaccctttatgacaacttgacggctacatcattcactttttcttcacaaccggcacggaactcgctcgggctggccccggtgcattttttaaatacccgcgagaaatagagttgatcgtcaaaaccaacattgcgaccgacggtggcgataggcatccgggtggtgctcaaaagcagcttcgcctggctgatacgttggtcctcgcgccagcttaagacgctaatccctaactgctggcggaaaagatgtgacagacgcgacggcgacaagcaaacatgctgtgcgacgctggcgatatcaaaattgctgtctgccaggtgatcgctgatgtactgacaagcctcgcgtacccgattatccatcggtggatggagcgactcgttaatcgcttccatgcgccgcagtaacaattgctcaagcagatttatcgccagcagctccgaatagcgcccttccccttgcccggcgttaatgatttgcccaaacaggtcgctgaaatgcggctggtgcgcttcatccgggcgaaagaaccccgtattggcaaatattgacggccagttaagccattcatgccagtaggcgcgcggacgaaagtaaacccactggtgataccattcgcgagcctccggatgacgaccgtagtgatgaatctctcctggcgggaacagcaaaatatcacccggtcggcaaacaaattctcgtccctgatttttcaccaccccctgaccgcgaatggtgagattgagaatataacctttcattcccagcggtcggtcgataaaaaaatcgagataaccgttggcctcaatcggcgttaaacccgccaccagatgggcattaaacgagtatcccggcagcaggggatcattttgcgcttcagccatacttttcatactcccaccattcagagaagaaaccaattgtccatattgcatcagacattgccgtcactgcgtcttttactggctcttctcgctaacccaaccggtaaccccgcttattaaaagcattctgtaacaaagcgggaccaaagccatgacaaaaacgcgtaacaaaagtgtctataatcacggcagaaaagtccacattgattatttgcacggcgtcacactttgctatgccatagcatttttatccataagattagcggatcctacctgacgctttttatcgcaactctctactgtttctccatacccgtttttttggacgcgtacaactcaagtctgacataaatgaccgctatgagcactgcaattacacgccagatcgttctcgctaccgcaaccaccggtatgaaccagattggtgcgcactatgaaggccacaagatcattgagattggtgccgttgaagtggtgaaccgtcgcctgacgggcaataacttccatgtttatctcaaacccgatcggctggtggatccggaagcctttggcgtacatggtattgccgatgaatttttgctcgataagcccacgtttgccgaagtagccgatgagttcatggactatattcgcggcgcggagttggtgatccataacgcagcgttcgatatcggctttatggactacgagttttcgttgcttaagcgcgatattccgaagaccaatactttctgtaaggtcaccgatagccttgcggtggcgaggaaaatgtttcccggtaagcgcaacagcctcgatgcgttatgtgctcgctacgaaatagataacagtaaacgaacgctgcacggggcattactcgatgcccagatccttgcggaagtttatctggcgatgaccggtggtcaaacgtcgatggcttttgcgatggaaggagagacacaacagcaacaaggtgaagcaacaattcagcgcattgtacgtcaggcaagtaagttacgcgttgtttttgcgacagatgaagagattgcagctcatgaagcccgtctcgatctggtgcagaagaaaggcggaagttgcctctggcgagcataatttaatatcagtaaaccggacataacccatgaagaaaaatcgcgcttttttgaagtgggcagggggcaagtatcccctgcttgatgatattaaacggcatttgcccaagggcgaatgtctggttgagccttttgtaggtgccgggtcggtgtttctcaacaccgacttttctcgttatatccttgccgatatcaatagcgacctgatcagtctctataacattgtgaagatgcgtactgatgagtacgtacaggccgcacgcgagctgtttgttcccgaaacaaattgcgccgaggtttactatcagttccgcgaagagttcaacaaaagccaggatccgttccgtcgggcggtactgtttttatatttgaaccgctacggttacaacggcctgtgtcgttacaatctgcgcggtgagtttaacgtgccgttcggccgctacaaaaaaccctatttcccggaagcagagttgtatcacttcgctgaaaaagcgcagaatgcctttttctattgtgagtcttacgccgatagcatggcgcgcgcagatgatgcatccgtcgtctattgcgatccgccttatgcaccgctgtctgcgaccgccaactttacggcgtatcacacaaacagttttacgcttgaacaacaagcgcatctggcggagatcgccgaaggtctggttgagcgccatattccagtgctgatctccaatcacgatacgatgttaacgcgtgagtggtatcagcgcgcaaaattgcatgtcgtcaaagttcgacgcagtataagcagcaacggcggcacacgtaaaaaggtggacgaactgctggctttgtacaaaccaggagtcgtttcacccgcgaaaaaataattcagctaagacactgcactggattaagatgaaaacgattgaagttgatgatgaactctacagctatattgccagccacactaagcatatcggcgagagcgcatccgacattttacggcgtatgttgaaattttccgccgcatcacagcctgctgctccggtgacgaaagaggttcgcgttgcgtcacctgctatcgtcgaagcgaagccggtcaaaacgattaaagacaaggttcgcgcaatgcgtgaacttctgctttcggatgaatacgcagagcaaaagcgagcggtcaatcgctttatgctgctgttgtctacactatattctcttgacgcccaggcgtttgccgaagcaacggaatcgttgcacggtcgtacacgcgtttactttgcggcagatgaacaaacgctgctgaaaaatggtaatcagaccaagccgaaacatgtgccaggcacgccgtattgggtgatcaccaacaccaacaccggccgtaaatgcagcatgatcgaacacatcatgcagtcgatgcaattcccggcggaattgattgagaaggtttgcggaactatctaaaaaacgttcgtaaaggagtaaccgaattttggcaacgacaaccgcagaatgcctgacgcaggaaacgatggattaccacgcgctgaatgcgatgcttaacctctacgatagcgcaggtcgcattcagttcgataaagaccgccaggccgttgacgcctttattgcgacgcatgtgcgtccgaacagtgtgaccttcagtagccagcagcagcgcctgaactggctggtcaacgaaggttactatgatgaaagcgttcttaatcgctactctcgcgactttgtcattacgctgtttacccacgcacacaccagcggttttcgtttccagacattcctcggggcatggaagttttacaccagctatacgttgaagacattcgacggtaaacgttatctggaagattttgccgatcgagtaacgatggtggcgctgacgctggcacaaggcgatgagacgctggcgttgcaactgaccgatgaaatgctgtcaggacgctttcagccagccacgccaacattcctcaactgcggtaagcagcagcgcggcgaactggtttcctgttttttgctgcgtattgaagacaatatggagtcgattggtcgggcggtaaattccgcactgcagctgtcgaaacgcggcggcggcgtagcatttttgctgtcgaatctgcgagaagcgggcgcgccaattaaacgtattgaaaatcaatcttctggcgtaattccggtgatgaaaatgctggaagacgcattttcctatgccaaccaactcggcgctcgtcagggggctggtgcagtctatttacatgctcatcatcccgatattctgcgttttctcgacacgaaacgggaaaatgccgacgaaaaaatccgcattaaaacactgtcgcttggcgtggtgatcccggatatcactttccatctggcaaaagagaatgcgcagatggcgctgttttcgccttatgacgtagagcgagtttatggcaagccgtttgccgatgtggccatcagccaacactatgacgaactggttgccgatgaacgcattcgcaaaaaatacctcaacgcccgtgatttcttccagcgactggcagaaatccagtttgagtccggctatccctacatcatgtatgaagacacggtaaaccgtgctaaccctatcgccgggcgcataaatatgagtaatctctgctcagaaattttgcaggttaacagcgcctcagagtatgacgagaatctcgactatacccgcacaggccatgatatttcctgcaatttaggttcgttgaatattgcgcacaccatggattcccccgattttgcccgcacggtagagactgccgtgcgcggtttaacggcagtatcagatatgagtcatatccgcagcgtgccgtccatcgaagccggaaatgccgcctcgcacgccatcggactggggcagatgaatttacacggctatctggcgcgagaaggcatcgcttatggttcgccggaagcactggatttcaccaatctctatttctatgccatcacctggcatgcactgcgtacctcgatgttgctggcacgcgaacgcggtgaaaccttcgccgggttcaaacagtcacgctatgccagtggtgaatattttagccaatatctgcaagggaactggcagccgaaaacggcgaaagttggcgaactgtttacccgtagcggtattacgttacctacccgtgagatgtgggcgcagctgcgcgacgacgtgatgcgctacggcatatacaaccagaatcttcaggcggtgccgccaaccggttctatctcttatatcaaccatgctacgtcgagtattcatccgattgtggcgaaagtagagatacgcaaagagggcaaaacaggacgcgtttactaccctgccccgtttatgactaacgagaatctggcgctgtatcaggacgcttacgaaattggcgcagaaaagatcatcgacacctacgcggaagcgactcgccatgtcgatcaggggctgtcgctgacgctttttttccccgataccgccaccactcgcgatatcaacaaagcgcagatttacgcctggcgcaagggtatcaaaacgctctattacatccgcctgcgtcagatggcgctggaaggcactgaaattgaaggctgcgtctcctgtgcactttaaggaatatctatgaaactctcacgtatcagcgccatcaactggaacaagatatctgacgataaagatctggaggtgtggaatcgcctgaccagcaatttctggctaccagaaaaggtgccgctgtcgaacgatattcctgcctggcagacattaactgtcgtagaacaacaactgacgatgcgcgtttttactggcctgacgctgctcgacacgctgcaaaatgttatcggcgcgccttctctgatgcccgatgcactcacgcctcatgaagaagcggtattatcgaatatcagctttatggaagcggttcatgcccgctcttacagttcgattttctcgacgctatgccagaccaaagatgtcgatgccgcctacgcctggagtgaagaaaacgcaccgttgcagcgaaaagctcagattattcagcaacattatcgcggtgatgatccgctgaaaaagaaaatcgccagtgtgtttcttgaatcttttttgttctattccggtttctggctgccgatgtatttttccagccgcggaaagctgaccaataccgcggacctgatccgtctgattatccgcgatgaagcagtccacggttactacataggctataaatatcagaaaaacatggaaaagatatctctgggacaacgtgaagagttgaagagtttcgccttcgatttgttgctggaactctacgacaacgagttgcaatacaccgatgagctgtacgccgaaaccccgtgggctgacgatgtgaaagcgtttctctgttacaacgccaataaggctttgatgaatctgggctacgaaccgttatttcccgcagaaatggcggaagtgaatccggcaatcctcgccgcgctttcgccgaatgccgatgaaaatcacgatttcttttccggttcaggctcctcttatgtgatggggaaagcggttgaaacagaagatgaagactggaatttctgaacttaattaacggcactcctcagccaagtcaaaagcctccgaccggaggcttttgactacatgcccatggcgtttacgccccgccctgccactcatcgcagtactgttgtaattcattaagcattctgccgacatggaagccatcacaaacggcatgatgaacctgaatcgccagcggcatcagcaccttgtcgccttgcgtataatatttgcccatagtgaaaacgggggcgaagaagttgtccatattggccacgtttaaatcaaaactggtgaaactcacccagggattggctgagacgaaaaacatattctcaataaaccctttagggaaataggccaggttttcaccgtaacacgccacatcttgcgaatatatgtgtagaaactgccggaaatcgtcgtggtattcactccagagcgatgaaaacgtttcagtttgctcatggaaaacggtgtaacaagggtgaacactatcccatatcaccagctcaccgtctttcattgccatacggaactccggatgagcattcatcaggcgggcaagaatgtgaataaaggccggataaaacttgtgcttatttttctttacggtctttaaaaaggccgtaatatccagctgaacggtctggttataggtacattgagtaactgactgaaatgcctcaaaatgttctttacgatgccattgggatatatcaacggtggtatatccagtgatttttttctccattttagcttccttagctcctgaaaatctcgataactcaaaaaatacgcccggtagtgatcttatttcattatggtgaaagttggaacctcttacgtgccaagccaaataggccgt

SEQ ID NO: 93 - DNA, 5505 bp, Artificial Sequence
  Synthetic Polynucleotide
cactcggtcgctacgctccgggcgtgagactgcggcgggcgctgcggacacatacaaagttacccacagattccgtggataagcaggggactaacatgtgaggcaaaacagcagggccgcgccggtggcgtttttccataggctccgccctcctgccagagttcacataaacagacgcttttccggtgcatctgtgggagccgtgaggctcaaccatgaatctgacagtacgggcgaaacccgacaggacttaaagatccccaccgtttccggcgggtcgctccctcttgcgctctcctgttccgaccctgccgtttaccggatacctgttccgcctttctcccttacgggaagtgtggcgctttctcatagctcacacactggtatctcggctcggtgtaggtcgttcgctccaagctgggctgtaagcaagaactccccgttcagcccgactgctgcgccttatccggtaactgttcacttgagtccaacccggaaaagcacggtaaaacgccactggcagcagccattggtaactgggagttcgcagaggatttgtttagctaaacacgcggttgctcttgaagtgtgcgccaaagtccggctacactggaaggacagatttggttgctgtgctctgcgaaagccagttaccacggttaagcagttccccaactgacttaaccttcgatcaaaccacctccccaggtggttttttcgtttacagggcaaaagattacgcgcagaaaaaaaggatctcaagaagatcctttgatcttttctactgaaccgctctagatttcagtgcaatttatctcttcaaatgtagcacctgaagtcagcccaggaggaagaggacatccggtcaaataaaacgaaaggctcagtcgaaagactgggcctttcgttttagacttagggaccctttatgacaacttgacggctacatcattcactttttcttcacaaccggcacggaactcgctcgggctggccccggtgcattttttaaatacccgcgagaaatagagttgatcgtcaaaaccaacattgcgaccgacggtggcgataggcatccgggtggtgctcaaaagcagcttcgcctggctgatacgttggtcctcgcgccagcttaagacgctaatccctaactgctggcggaaaagatgtgacagacgcgacggcgacaagcaaacatgctgtgcgacgctggcgatatcaaaattgctgtctgccaggtgatcgctgatgtactgacaagcctcgcgtacccgattatccatcggtggatggagcgactcgttaatcgcttccatgcgccgcagtaacaattgctcaagcagatttatcgccagcagctccgaatagcgcccttccccttgcccggcgttaatgatttgcccaaacaggtcgctgaaatgcggctggtgcgcttcatccgggcgaaagaaccccgtattggcaaatattgacggccagttaagccattcatgccagtaggcgcgcggacgaaagtaaacccactggtgataccattcgcgagcctccggatgacgaccgtagtgatgaatctctcctggcgggaacagcaaaatatcacccggtcggcaaacaaattctcgtccctgatttttcaccaccccctgaccgcgaatggtgagattgagaatataacctttcattcccagcggtcggtcgataaaaaaatcgagataaccgttggcctcaatcggcgttaaacccgccaccagatgggcattaaacgagtatcccggcagcaggggatcattttgcgcttcagccatacttttcatactcccaccattcagagaagaaaccaattgtccatattgcatcagacattgccgtcactgcgtcttttactggctcttctcgctaacccaaccggtaaccccgcttattaaaagcattctgtaacaaagcgggaccaaagccatgacaaaaacgcgtaacaaaagtgtctataatcacggcagaaaagtccacattgattatttgcacggcgtcacactttgctatgccatagcatttttatccataagattagcggatcctacctgacgctttttatcgcaactctctactgtttctccatacccgtttttttggacgcgtacaactcaagtctgacataaatgaccgctatgagcactgcaattacacgccagatcgttctcgctaccgcaaccaccggtatgaaccagattggtgcgcactatgaaggccacaagatcattgagattggtgccgttgaagtggtgaaccgtcgcctgacgggcaataacttccatgtttatctcaaacccgatcggctggtggatccggaagcctttggcgtacatggtattgccgatgaatttttgctcgataagcccacgtttgccgaagtagccgatgagttcatggactatattcgcggcgcggagttggtgatccataacgcagcgttcgatatcggctttatggactacgagttttcgttgcttaagcgcgatattccgaagaccaatactttctgtaaggtcaccgatagccttgcggtggcgaggaaaatgtttcccggtaagcgcaacagcctcgatgcgttatgtgctcgctacgaaatagataacagtaaacgaacgctgcacggggcattactcgatgcccagatccttgcggaagtttatctggcgatgaccggtggtcaaacgtcgatggcttttgcgatggaaggagagacacaacagcaacaaggtgaagcaacaattcagcgcattgtacgtcaggcaagtaagttacgcgttgtttttgcgacagatgaagagattgcagctcatgaagcccgtctcgatctggtgcagaagaaaggcggaagttgcctctggcgagcataatttaatatcagtaaaccggacataacccatgaagaaaaatcgcgcttttttgaagtgggcagggggcaagtatcccctgcttgatgatattaaacggcatttgcccaagggcgaatgtctggttgagccttttgtaggtgccgggtcggtgtttctcaacaccgacttttctcgttatatccttgccgatatcaatagcgacctgatcagtctctataacattgtgaagatgcgtactgatgagtacgtacaggccgcacgcgagctgtttgttcccgaaacaaattgcgccgaggtttactatcagttccgcgaagagttcaacaaaagccaggatccgttccgtcgggcggtactgtttttatatttgaaccgctacggttacaacggcctgtgtcgttacaatctgcgcggtgagtttaacgtgccgttcggccgctacaaaaaaccctatttcccggaagcagagttgtatcacttcgctgaaaaagcgcagaatgcctttttctattgtgagtcttacgccgatagcatggcgcgcgcagatgatgcatccgtcgtctattgcgatccgccttatgcaccgctgtctgcgaccgccaactttacggcgtatcacacaaacagttttacgcttgaacaacaagcgcatctggcggagatcgccgaaggtctggttgagcgccatattccagtgctgatctccaatcacgatacgatgttaacgcgtgagtggtatcagcgcgcaaaattgcatgtcgtcaaagttcgacgcagtataagcagcaacggcggcacacgtaaaaaggtggacgaactgctggctttgtacaaaccaggagtcgtttcacccgcgaaaaaataattcagctaagacactgcactggattaagatgaaaacgattgaagttgatgatgaactctacagctatattgccagccacactaagcatatcggcgagagcgcatccgacattttacggcgtatgttgaaattttccgccgcatcacagcctgctgctccggtgacgaaagaggttcgcgttgcgtcacctgctatcgtcgaagcgaagccggtcaaaacgattaaagacaaggttcgcgcaatgcgtgaacttctgctttcggatgaatacgcagagcaaaagcgagcggtcaatcgctttatgctgctgttgtctacactatattctcttgacgcccaggcgtttgccgaagcaacggaatcgttgcacggtcgtacacgcgtttactttgcggcagatgaacaaacgctgctgaaaaatggtaatcagaccaagccgaaacatgtgccaggcacgccgtattgggtgatcaccaacaccaacaccggccgtaaatgcagcatgatcgaacacatcatgcagtcgatgcaattcccggcggaattgattgagaaggtttgcggaactatctaatctggaccctgataaagaggaaagcacaatggaagcattaggaatgatcgaaacccggggcctggttgcactgattgaggcttctgacgcgatggtgaaagctgcgcgcgtcaagctggttggtgttaagcagattggcggcggcctgtgtactgccatggttcgtggtgatgttgcagcctgtaaagccgcgaccgatgcaggtgccgcagcggcacagcgtatcggcgagctggtatctgtacacgttatcccgcgtccgcacggcgacctggaagaagtcttcccgatcggcctgaaaggcgatagcagcaacctgtaaacttaattaacggcactcctcagccaagtcaaaagcctccgaccggaggcttttgactacatgcccatggcgtttacgccccgccctgccactcatcgcagtactgttgtaattcattaagcattctgccgacatggaagccatcacaaacggcatgatgaacctgaatcgccagcggcatcagcaccttgtcgccttgcgtataatatttgcccatagtgaaaacgggggcgaagaagttgtccatattggccacgtttaaatcaaaactggtgaaactcacccagggattggctgagacgaaaaacatattctcaataaaccctttagggaaataggccaggttttcaccgtaacacgccacatcttgcgaatatatgtgtagaaactgccggaaatcgtcgtggtattcactccagagcgatgaaaacgtttcagtttgctcatggaaaacggtgtaacaagggtgaacactatcccatatcaccagctcaccgtctttcattgccatacggaactccggatgagcattcatcaggcgggcaagaatgtgaataaaggccggataaaacttgtgcttatttttctttacggtctttaaaaaggccgtaatatccagctgaacggtctggttataggtacattgagtaactgactgaaatgcctcaaaatgttctttacgatgccattgggatatatcaacggtggtatatccagtgatttttttctccattttagcttccttagctcctgaaaatctcgataactcaaaaaatacgcccggtagtgatcttatttcattatggtgaaagttggaacctcttacgtgccaagccaaataggccgt

SEQ ID NO: 94 - DNA, 5712 bp, Artificial Sequence
  Synthetic Polynucleotide
cactcggtcgctacgctccgggcgtgagactgcggcgggcgctgcggacacatacaaagttacccacagattccgtggataagcaggggactaacatgtgaggcaaaacagcagggccgcgccggtggcgtttttccataggctccgccctcctgccagagttcacataaacagacgcttttccggtgcatctgtgggagccgtgaggctcaaccatgaatctgacagtacgggcgaaacccgacaggacttaaagatccccaccgtttccggcgggtcgctccctcttgcgctctcctgttccgaccctgccgtttaccggatacctgttccgcctttctcccttacgggaagtgtggcgctttctcatagctcacacactggtatctcggctcggtgtaggtcgttcgctccaagctgggctgtaagcaagaactccccgttcagcccgactgctgcgccttatccggtaactgttcacttgagtccaacccggaaaagcacggtaaaacgccactggcagcagccattggtaactgggagttcgcagaggatttgtttagctaaacacgcggttgctcttgaagtgtgcgccaaagtccggctacactggaaggacagatttggttgctgtgctctgcgaaagccagttaccacggttaagcagttccccaactgacttaaccttcgatcaaaccacctccccaggtggttttttcgtttacagggcaaaagattacgcgcagaaaaaaaggatctcaagaagatcctttgatcttttctactgaaccgctctagatttcagtgcaatttatctcttcaaatgtagcacctgaagtcagcccaggaggaagaggacatccggtcaaataaaacgaaaggctcagtcgaaagactgggcctttcgttttagacttagggaccctttatgacaacttgacggctacatcattcactttttcttcacaaccggcacggaactcgctcgggctggccccggtgcattttttaaatacccgcgagaaatagagttgatcgtcaaaaccaacattgcgaccgacggtggcgataggcatccgggtggtgctcaaaagcagcttcgcctggctgatacgttggtcctcgcgccagcttaagacgctaatccctaactgctggcggaaaagatgtgacagacgcgacggcgacaagcaaacatgctgtgcgacgctggcgatatcaaaattgctgtctgccaggtgatcgctgatgtactgacaagcctcgcgtacccgattatccatcggtggatggagcgactcgttaatcgcttccatgcgccgcagtaacaattgctcaagcagatttatcgccagcagctccgaatagcgcccttccccttgcccggcgttaatgatttgcccaaacaggtcgctgaaatgcggctggtgcgcttcatccgggcgaaagaaccccgtattggcaaatattgacggccagttaagccattcatgccagtaggcgcgcggacgaaagtaaacccactggtgataccattcgcgagcctccggatgacgaccgtagtgatgaatctctcctggcgggaacagcaaaatatcacccggtcggcaaacaaattctcgtccctgatttttcaccaccccctgaccgcgaatggtgagattgagaatataacctttcattcccagcggtcggtcgataaaaaaatcgagataaccgttggcctcaatcggcgttaaacccgccaccagatgggcattaaacgagtatcccggcagcaggggatcattttgcgcttcagccatacttttcatactcccaccattcagagaagaaaccaattgtccatattgcatcagacattgccgtcactgcgtcttttactggctcttctcgctaacccaaccggtaaccccgcttattaaaagcattctgtaacaaagcgggaccaaagccatgacaaaaacgcgtaacaaaagtgtctataatcacggcagaaaagtccacattgattatttgcacggcgtcacactttgctatgccatagcatttttatccataagattagcggatcctacctgacgctttttatcgcaactctctactgtttctccatacccgtttttttggacgcgtacaactcaagtctgacataaatgaccgctatgagcactgcaattacacgccagatcgttctcgctaccgcaaccaccggtatgaaccagattggtgcgcactatgaaggccacaagatcattgagattggtgccgttgaagtggtgaaccgtcgcctgacgggcaataacttccatgtttatctcaaacccgatcggctggtggatccggaagcctttggcgtacatggtattgccgatgaatttttgctcgataagcccacgtttgccgaagtagccgatgagttcatggactatattcgcggcgcggagttggtgatccataacgcagcgttcgatatcggctttatggactacgagttttcgttgcttaagcgcgatattccgaagaccaatactttctgtaaggtcaccgatagccttgcggtggcgaggaaaatgtttcccggtaagcgcaacagcctcgatgcgttatgtgctcgctacgaaatagataacagtaaacgaacgctgcacggggcattactcgatgcccagatccttgcggaagtttatctggcgatgaccggtggtcaaacgtcgatggcttttgcgatggaaggagagacacaacagcaacaaggtgaagcaacaattcagcgcattgtacgtcaggcaagtaagttacgcgttgtttttgcgacagatgaagagattgcagctcatgaagcccgtctcgatctggtgcagaagaaaggcggaagttgcctctggcgagcataatttaatatcagtaaaccggacataacccatgaagaaaaatcgcgcttttttgaagtgggcagggggcaagtatcccctgcttgatgatattaaacggcatttgcccaagggcgaatgtctggttgagccttttgtaggtgccgggtcggtgtttctcaacaccgacttttctcgttatatccttgccgatatcaatagcgacctgatcagtctctataacattgtgaagatgcgtactgatgagtacgtacaggccgcacgcgagctgtttgttcccgaaacaaattgcgccgaggtttactatcagttccgcgaagagttcaacaaaagccaggatccgttccgtcgggcggtactgtttttatatttgaaccgctacggttacaacggcctgtgtcgttacaatctgcgcggtgagtttaacgtgccgttcggccgctacaaaaaaccctatttcccggaagcagagttgtatcacttcgctgaaaaagcgcagaatgcctttttctattgtgagtcttacgccgatagcatggcgcgcgcagatgatgcatccgtcgtctattgcgatccgccttatgcaccgctgtctgcgaccgccaactttacggcgtatcacacaaacagttttacgcttgaacaacaagcgcatctggcggagatcgccgaaggtctggttgagcgccatattccagtgctgatctccaatcacgatacgatgttaacgcgtgagtggtatcagcgcgcaaaattgcatgtcgtcaaagttcgacgcagtataagcagcaacggcggcacacgtaaaaaggtggacgaactgctggctttgtacaaaccaggagtcgtttcacccgcgaaaaaataattcagctaagacactgcactggattaagatgaaaacgattgaagttgatgatgaactctacagctatattgccagccacactaagcatatcggcgagagcgcatccgacattttacggcgtatgttgaaattttccgccgcatcacagcctgctgctccggtgacgaaagaggttcgcgttgcgtcacctgctatcgtcgaagcgaagccggtcaaaacgattaaagacaaggttcgcgcaatgcgtgaacttctgctttcggatgaatacgcagagcaaaagcgagcggtcaatcgctttatgctgctgttgtctacactatattctcttgacgcccaggcgtttgccgaagcaacggaatcgttgcacggtcgtacacgcgtttactttgcggcagatgaacaaacgctgctgaaaaatggtaatcagaccaagccgaaacatgtgccaggcacgccgtattgggtgatcaccaacaccaacaccggccgtaaatgcagcatgatcgaacacatcatgcagtcgatgcaattcccggcggaattgattgagaaggtttgcggaactatctaaaatccagcgtgcgtaacggaggttgccgatgatcaatgcactgggattgctggaagtggacggcatggtcgccgcgatagatgcagcggatgccatgctcaaagcagctaacgttcgtctgctcagtcacgaagtgcttgaccctggtcgcttaacgctggtggtggaaggcgatctggcggcgtgtcgtgcggcgctggacgcaggttgtgctgccgcgatgcgtaccgggcgtgtcatcagccgcaaggagatcggtcggccagacgatgacacccagtggctggttactggctttaaccgccagccgaagcaacccgtaagggaacccgacgcgccagttatcgtcgcggaatctgctgacgagttgttggcgctgttaacatcagtacgtcagggaatgacggcaggagaagtggctgcccactttggctggccgctggaaaaagccagaaatgcgctcgaacagctcttttctgccgggacgttacgtaaacgcagtagtcgttatcgtctcaagccccattaaacttaattaacggcactcctcagccaagtcaaaagcctccgaccggaggcttttgactacatgcccatggcgtttacgccccgccctgccactcatcgcagtactgttgtaattcattaagcattctgccgacatggaagccatcacaaacggcatgatgaacctgaatcgccagcggcatcagcaccttgtcgccttgcgtataatatttgcccatagtgaaaacgggggcgaagaagttgtccatattggccacgtttaaatcaaaactggtgaaactcacccagggattggctgagacgaaaaacatattctcaataaaccctttagggaaataggccaggttttcaccgtaacacgccacatcttgcgaatatatgtgtagaaactgccggaaatcgtcgtggtattcactccagagcgatgaaaacgtttcagtttgctcatggaaaacggtgtaacaagggtgaacactatcccatatcaccagctcaccgtctttcattgccatacggaactccggatgagcattcatcaggcgggcaagaatgtgaataaaggccggataaaacttgtgcttatttttctttacggtctttaaaaaggccgtaatatccagctgaacggtctggttataggtacattgagtaactgactgaaatgcctcaaaatgttctttacgatgccattgggatatatcaacggtggtatatccagtgatttttttctccattttagcttccttagctcctgaaaatctcgataactcaaaaaatacgcccggtagtgatcttatttcattatggtgaaagttggaacctcttacgtgccaagccaaataggccgt

SEQ ID NO: 95 - DNA, 5694 bp, Artificial Sequence
  Synthetic Polynucleotide
cactcggtcgctacgctccgggcgtgagactgcggcgggcgctgcggacacatacaaagttacccacagattccgtggataagcaggggactaacatgtgaggcaaaacagcagggccgcgccggtggcgtttttccataggctccgccctcctgccagagttcacataaacagacgcttttccggtgcatctgtgggagccgtgaggctcaaccatgaatctgacagtacgggcgaaacccgacaggacttaaagatccccaccgtttccggcgggtcgctccctcttgcgctctcctgttccgaccctgccgtttaccggatacctgttccgcctttctcccttacgggaagtgtggcgctttctcatagctcacacactggtatctcggctcggtgtaggtcgttcgctccaagctgggctgtaagcaagaactccccgttcagcccgactgctgcgccttatccggtaactgttcacttgagtccaacccggaaaagcacggtaaaacgccactggcagcagccattggtaactgggagttcgcagaggatttgtttagctaaacacgcggttgctcttgaagtgtgcgccaaagtccggctacactggaaggacagatttggttgctgtgctctgcgaaagccagttaccacggttaagcagttccccaactgacttaaccttcgatcaaaccacctccccaggtggttttttcgtttacagggcaaaagattacgcgcagaaaaaaaggatctcaagaagatcctttgatcttttctactgaaccgctctagatttcagtgcaatttatctcttcaaatgtagcacctgaagtcagcccaggaggaagaggacatccggtcaaataaaacgaaaggctcagtcgaaagactgggcctttcgttttagacttagggaccctttatgacaacttgacggctacatcattcactttttcttcacaaccggcacggaactcgctcgggctggccccggtgcattttttaaatacccgcgagaaatagagttgatcgtcaaaaccaacattgcgaccgacggtggcgataggcatccgggtggtgctcaaaagcagcttcgcctggctgatacgttggtcctcgcgccagcttaagacgctaatccctaactgctggcggaaaagatgtgacagacgcgacggcgacaagcaaacatgctgtgcgacgctggcgatatcaaaattgctgtctgccaggtgatcgctgatgtactgacaagcctcgcgtacccgattatccatcggtggatggagcgactcgttaatcgcttccatgcgccgcagtaacaattgctcaagcagatttatcgccagcagctccgaatagcgcccttccccttgcccggcgttaatgatttgcccaaacaggtcgctgaaatgcggctggtgcgcttcatccgggcgaaagaaccccgtattggcaaatattgacggccagttaagccattcatgccagtaggcgcgcggacgaaagtaaacccactggtgataccattcgcgagcctccggatgacgaccgtagtgatgaatctctcctggcgggaacagcaaaatatcacccggtcggcaaacaaattctcgtccctgatttttcaccaccccctgaccgcgaatggtgagattgagaatataacctttcattcccagcggtcggtcgataaaaaaatcgagataaccgttggcctcaatcggcgttaaacccgccaccagatgggcattaaacgagtatcccggcagcaggggatcattttgcgcttcagccatacttttcatactcccaccattcagagaagaaaccaattgtccatattgcatcagacattgccgtcactgcgtcttttactggctcttctcgctaacccaaccggtaaccccgcttattaaaagcattctgtaacaaagcgggaccaaagccatgacaaaaacgcgtaacaaaagtgtctataatcacggcagaaaagtccacattgattatttgcacggcgtcacactttgctatgccatagcatttttatccataagattagcggatcctacctgacgctttttatcgcaactctctactgtttctccatacccgtttttttggacgcgtacaactcaagtctgacataaatgaccgctatgagcactgcaattacacgccagatcgttctcgctaccgcaaccaccggtatgaaccagattggtgcgcactatgaaggccacaagatcattgagattggtgccgttgaagtggtgaaccgtcgcctgacgggcaataacttccatgtttatctcaaacccgatcggctggtggatccggaagcctttggcgtacatggtattgccgatgaatttttgctcgataagcccacgtttgccgaagtagccgatgagttcatggactatattcgcggcgcggagttggtgatccataacgcagcgttcgatatcggctttatggactacgagttttcgttgcttaagcgcgatattccgaagaccaatactttctgtaaggtcaccgatagccttgcggtggcgaggaaaatgtttcccggtaagcgcaacagcctcgatgcgttatgtgctcgctacgaaatagataacagtaaacgaacgctgcacggggcattactcgatgcccagatccttgcggaagtttatctggcgatgaccggtggtcaaacgtcgatggcttttgcgatggaaggagagacacaacagcaacaaggtgaagcaacaattcagcgcattgtacgtcaggcaagtaagttacgcgttgtttttgcgacagatgaagagattgcagctcatgaagcccgtctcgatctggtgcagaagaaaggcggaagttgcctctggcgagcataatttaatatcagtaaaccggacataacccatgaagaaaaatcgcgcttttttgaagtgggcagggggcaagtatcccctgcttgatgatattaaacggcatttgcccaagggcgaatgtctggttgagccttttgtaggtgccgggtcggtgtttctcaacaccgacttttctcgttatatccttgccgatatcaatagcgacctgatcagtctctataacattgtgaagatgcgtactgatgagtacgtacaggccgcacgcgagctgtttgttcccgaaacaaattgcgccgaggtttactatcagttccgcgaagagttcaacaaaagccaggatccgttccgtcgggcggtactgtttttatatttgaaccgctacggttacaacggcctgtgtcgttacaatctgcgcggtgagtttaacgtgccgttcggccgctacaaaaaaccctatttcccggaagcagagttgtatcacttcgctgaaaaagcgcagaatgcctttttctattgtgagtcttacgccgatagcatggcgcgcgcagatgatgcatccgtcgtctattgcgatccgccttatgcaccgctgtctgcgaccgccaactttacggcgtatcacacaaacagttttacgcttgaacaacaagcgcatctggcggagatcgccgaaggtctggttgagcgccatattccagtgctgatctccaatcacgatacgatgttaacgcgtgagtggtatcagcgcgcaaaattgcatgtcgtcaaagttcgacgcagtataagcagcaacggcggcacacgtaaaaaggtggacgaactgctggctttgtacaaaccaggagtcgtttcacccgcgaaaaaataattcagctaagacactgcactggattaagatgaaaacgattgaagttgatgatgaactctacagctatattgccagccacactaagcatatcggcgagagcgcatccgacattttacggcgtatgttgaaattttccgccgcatcacagcctgctgctccggtgacgaaagaggttcgcgttgcgtcacctgctatcgtcgaagcgaagccggtcaaaacgattaaagacaaggttcgcgcaatgcgtgaacttctgctttcggatgaatacgcagagcaaaagcgagcggtcaatcgctttatgctgctgttgtctacactatattctcttgacgcccaggcgtttgccgaagcaacggaatcgttgcacggtcgtacacgcgtttactttgcggcagatgaacaaacgctgctgaaaaatggtaatcagaccaagccgaaacatgtgccaggcacgccgtattgggtgatcaccaacaccaacaccggccgtaaatgcagcatgatcgaacacatcatgcagtcgatgcaattcccggcggaattgattgagaaggtttgcggaactatctaattatgcgcattattgattaaggatactcatgatggaacagtcactcatcccacagacaccggtacttccactgaccgcacaacgcacggtaaaacgcgccttaacgctgcttgaccgacacctgcgcgaaacaggcgtggcattcacctccactcaggctgctcgtgactggctgaagctgaaaatggcggggctggagcgtgaagaatttatgatgctgtatctgaaccagcagaaccagttgattgcccacgaaaccctgtttgccggttctattagcagtaccgaggtacatccccgtgaggtggtcaaacgcgccctgtatttcaatgcagcagcagtgatactggcgcataaccacccctccggcgacactactcccagccaggcagataagactataacgcagcgtctggtgcaggcgcttcagctcgttgatatccgtgtccctgaccatctgattgttggtggcaggcaaatctattcgttcgcagaacacggtctgctttgaacttaattaacggcactcctcagccaagtcaaaagcctccgaccggaggcttttgactacatgcccatggcgtttacgccccgccctgccactcatcgcagtactgttgtaattcattaagcattctgccgacatggaagccatcacaaacggcatgatgaacctgaatcgccagcggcatcagcaccttgtcgccttgcgtataatatttgcccatagtgaaaacgggggcgaagaagttgtccatattggccacgtttaaatcaaaactggtgaaactcacccagggattggctgagacgaaaaacatattctcaataaaccctttagggaaataggccaggttttcaccgtaacacgccacatcttgcgaatatatgtgtagaaactgccggaaatcgtcgtggtattcactccagagcgatgaaaacgtttcagtttgctcatggaaaacggtgtaacaagggtgaacactatcccatatcaccagctcaccgtctttcattgccatacggaactccggatgagcattcatcaggcgggcaagaatgtgaataaaggccggataaaacttgtgcttatttttctttacggtctttaaaaaggccgtaatatccagctgaacggtctggttataggtacattgagtaactgactgaaatgcctcaaaatgttctttacgatgccattgggatatatcaacggtggtatatccagtgatttttttctccattttagcttccttagctcctgaaaatctcgataactcaaaaaatacgcccggtagtgatcttatttcattatggtgaaagttggaacctcttacgtgccaagccaaataggccgt

SEQ ID NO: 96 - DNA, 6092 bp, Artificial Sequence
  Synthetic Polynucleotide
cactcggtcgctacgctccgggcgtgagactgcggcgggcgctgcggacacatacaaagttacccacagattccgtggataagcaggggactaacatgtgaggcaaaacagcagggccgcgccggtggcgtttttccataggctccgccctcctgccagagttcacataaacagacgcttttccggtgcatctgtgggagccgtgaggctcaaccatgaatctgacagtacgggcgaaacccgacaggacttaaagatccccaccgtttccggcgggtcgctccctcttgcgctctcctgttccgaccctgccgtttaccggatacctgttccgcctttctcccttacgggaagtgtggcgctttctcatagctcacacactggtatctcggctcggtgtaggtcgttcgctccaagctgggctgtaagcaagaactccccgttcagcccgactgctgcgccttatccggtaactgttcacttgagtccaacccggaaaagcacggtaaaacgccactggcagcagccattggtaactgggagttcgcagaggatttgtttagctaaacacgcggttgctcttgaagtgtgcgccaaagtccggctacactggaaggacagatttggttgctgtgctctgcgaaagccagttaccacggttaagcagttccccaactgacttaaccttcgatcaaaccacctccccaggtggttttttcgtttacagggcaaaagattacgcgcagaaaaaaaggatctcaagaagatcctttgatcttttctactgaaccgctctagatttcagtgcaatttatctcttcaaatgtagcacctgaagtcagcccaggaggaagaggacatccggtcaaataaaacgaaaggctcagtcgaaagactgggcctttcgttttagacttagggaccctttatgacaacttgacggctacatcattcactttttcttcacaaccggcacggaactcgctcgggctggccccggtgcattttttaaatacccgcgagaaatagagttgatcgtcaaaaccaacattgcgaccgacggtggcgataggcatccgggtggtgctcaaaagcagcttcgcctggctgatacgttggtcctcgcgccagcttaagacgctaatccctaactgctggcggaaaagatgtgacagacgcgacggcgacaagcaaacatgctgtgcgacgctggcgatatcaaaattgctgtctgccaggtgatcgctgatgtactgacaagcctcgcgtacccgattatccatcggtggatggagcgactcgttaatcgcttccatgcgccgcagtaacaattgctcaagcagatttatcgccagcagctccgaatagcgcccttccccttgcccggcgttaatgatttgcccaaacaggtcgctgaaatgcggctggtgcgcttcatccgggcgaaagaaccccgtattggcaaatattgacggccagttaagccattcatgccagtaggcgcgcggacgaaagtaaacccactggtgataccattcgcgagcctccggatgacgaccgtagtgatgaatctctcctggcgggaacagcaaaatatcacccggtcggcaaacaaattctcgtccctgatttttcaccaccccctgaccgcgaatggtgagattgagaatataacctttcattcccagcggtcggtcgataaaaaaatcgagataaccgttggcctcaatcggcgttaaacccgccaccagatgggcattaaacgagtatcccggcagcaggggatcattttgcgcttcagccatacttttcatactcccaccattcagagaagaaaccaattgtccatattgcatcagacattgccgtcactgcgtcttttactggctcttctcgctaacccaaccggtaaccccgcttattaaaagcattctgtaacaaagcgggaccaaagccatgacaaaaacgcgtaacaaaagtgtctataatcacggcagaaaagtccacattgattatttgcacggcgtcacactttgctatgccatagcatttttatccataagattagcggatcctacctgacgctttttatcgcaactctctactgtttctccatacccgtttttttggacgcgtacaactcaagtctgacataaatgaccgctatgagcactgcaattacacgccagatcgttctcgctaccgcaaccaccggtatgaaccagattggtgcgcactatgaaggccacaagatcattgagattggtgccgttgaagtggtgaaccgtcgcctgacgggcaataacttccatgtttatctcaaacccgatcggctggtggatccggaagcctttggcgtacatggtattgccgatgaatttttgctcgataagcccacgtttgccgaagtagccgatgagttcatggactatattcgcggcgcggagttggtgatccataacgcagcgttcgatatcggctttatggactacgagttttcgttgcttaagcgcgatattccgaagaccaatactttctgtaaggtcaccgatagccttgcggtggcgaggaaaatgtttcccggtaagcgcaacagcctcgatgcgttatgtgctcgctacgaaatagataacagtaaacgaacgctgcacggggcattactcgatgcccagatccttgcggaagtttatctggcgatgaccggtggtcaaacgtcgatggcttttgcgatggaaggagagacacaacagcaacaaggtgaagcaacaattcagcgcattgtacgtcaggcaagtaagttacgcgttgtttttgcgacagatgaagagattgcagctcatgaagcccgtctcgatctggtgcagaagaaaggcggaagttgcctctggcgagcataatttaatatcagtaaaccggacataacccatgaagaaaaatcgcgcttttttgaagtgggcagggggcaagtatcccctgcttgatgatattaaacggcatttgcccaagggcgaatgtctggttgagccttttgtaggtgccgggtcggtgtttctcaacaccgacttttctcgttatatccttgccgatatcaatagcgacctgatcagtctctataacattgtgaagatgcgtactgatgagtacgtacaggccgcacgcgagctgtttgttcccgaaacaaattgcgccgaggtttactatcagttccgcgaagagttcaacaaaagccaggatccgttccgtcgggcggtactgtttttatatttgaaccgctacggttacaacggcctgtgtcgttacaatctgcgcggtgagtttaacgtgccgttcggccgctacaaaaaaccctatttcccggaagcagagttgtatcacttcgctgaaaaagcgcagaatgcctttttctattgtgagtcttacgccgatagcatggcgcgcgcagatgatgcatccgtcgtctattgcgatccgccttatgcaccgctgtctgcgaccgccaactttacggcgtatcacacaaacagttttacgcttgaacaacaagcgcatctggcggagatcgccgaaggtctggttgagcgccatattccagtgctgatctccaatcacgatacgatgttaacgcgtgagtggtatcagcgcgcaaaattgcatgtcgtcaaagttcgacgcagtataagcagcaacggcggcacacgtaaaaaggtggacgaactgctggctttgtacaaaccaggagtcgtttcacccgcgaaaaaataattcagctaagacactgcactggattaagatgaaaacgattgaagttgatgatgaactctacagctatattgccagccacactaagcatatcggcgagagcgcatccgacattttacggcgtatgttgaaattttccgccgcatcacagcctgctgctccggtgacgaaagaggttcgcgttgcgtcacctgctatcgtcgaagcgaagccggtcaaaacgattaaagacaaggttcgcgcaatgcgtgaacttctgctttcggatgaatacgcagagcaaaagcgagcggtcaatcgctttatgctgctgttgtctacactatattctcttgacgcccaggcgtttgccgaagcaacggaatcgttgcacggtcgtacacgcgtttactttgcggcagatgaacaaacgctgctgaaaaatggtaatcagaccaagccgaaacatgtaccaggcacgccgtattgggtgatcaccaacaccaacaccggccgtaaatgcagcatgatcgaacacatcatgcagtcgatgcaattcccggcggaattgattgagaaggtttgcggaactatctaataatacaaaaattaggaggaatttcaacatgacaaatttatctgacatcattgaaaaagaaacaggaaaacaactagtgattcaagaatcaattctaatgttaccagaagaagtagaggaagtaattgggaataaaccagaaagtgatattttagttcatactgcttatgatgaaagtacagatgaaaatgtaatgctattaacttcagatgctccagaatataaaccttgggctttagtaattcaagacagtaatggagaaaataaaattaaaatgttataagtcgagattaagtaaaccggaatctgaagatggactctctgctgatgaaccgtcgtaaattcctgtaccagttcaaaaacgttcgttgggcgaaaggtcgtcgtgaaacctacctgtgctacgttgttaaacgtcgtgactctgcgacctctttctctctggacttcggttacctgcgtaacaaaaacggttgccacgttgaactgctgttcctgcgttacatctctgactgggacctggacccgggtcgttgctaccgtgttacctggttcacctcttggtctccgtgctacgactgcgcgcgtcacgttgcggacttcctgcgtggtaacccgaacctgtctctgcgtatcttcaccgcgcgtctgtacttctgcgaagaccgtaaagcggaaccggaaggtctgcgtcgtctgcaccgtgcgggtgttcagatcgcgatcatgaccttcaaagactacttctactgctggaacaccttcgttgaaaaccacgaacgtaccttcaaagcgtgggaaggtctgcacgaaaactctgttcgtctgtctcgtcagctgcgtcgtatcctgctgccgctgtacgaagttgacgacctgcgtgacgcgttccgtaccctgggtctgtaaacttaattaacggcactcctcagccaagtcaaaagcctccgaccggaggcttttgactacatgcccatggcgtttacgccccgccctgccactcatcgcagtactgttgtaattcattaagcattctgccgacatggaagccatcacaaacggcatgatgaacctgaatcgccagcggcatcagcaccttgtcgccttgcgtataatatttgcccatagtgaaaacgggggcgaagaagttgtccatattggccacgtttaaatcaaaactggtgaaactcacccagggattggctgagacgaaaaacatattctcaataaaccctttagggaaataggccaggttttcaccgtaacacgccacatcttgcgaatatatgtgtagaaactgccggaaatcgtcgtggtattcactccagagcgatgaaaacgtttcagtttgctcatggaaaacggtgtaacaagggtgaacactatcccatatcaccagctcaccgtctttcattgccatacggaactccggatgagcattcatcaggcgggcaagaatgtgaataaaggccggataaaacttgtgcttatttttctttacggtctttaaaaaggccgtaatatccagctgaacggtctggttataggtacattgagtaactgactgaaatgcctcaaaatgttctttacgatgccattgggatatatcaacggtggtatatccagtgatttttttctccattttagcttccttagctcctgaaaatctcgataactcaaaaaatacgcccggtagtgatcttatttcattatggtgaaagttggaacctcttacgtgccaagccaaataggccgt

SEQ ID NO: 97 - DNA, 6185 bp, Artificial Sequence
  Synthetic Polynucleotide
cactcggtcgctacgctccgggcgtgagactgcggcgggcgctgcggacacatacaaagttacccacagattccgtggataagcaggggactaacatgtgaggcaaaacagcagggccgcgccggtggcgtttttccataggctccgccctcctgccagagttcacataaacagacgcttttccggtgcatctgtgggagccgtgaggctcaaccatgaatctgacagtacgggcgaaacccgacaggacttaaagatccccaccgtttccggcgggtcgctccctcttgcgctctcctgttccgaccctgccgtttaccggatacctgttccgcctttctcccttacgggaagtgtggcgctttctcatagctcacacactggtatctcggctcggtgtaggtcgttcgctccaagctgggctgtaagcaagaactccccgttcagcccgactgctgcgccttatccggtaactgttcacttgagtccaacccggaaaagcacggtaaaacgccactggcagcagccattggtaactgggagttcgcagaggatttgtttagctaaacacgcggttgctcttgaagtgtgcgccaaagtccggctacactggaaggacagatttggttgctgtgctctgcgaaagccagttaccacggttaagcagttccccaactgacttaaccttcgatcaaaccacctccccaggtggttttttcgtttacagggcaaaagattacgcgcagaaaaaaaggatctcaagaagatcctttgatcttttctactgaaccgctctagatttcagtgcaatttatctcttcaaatgtagcacctgaagtcagcccaggaggaagaggacatccggtcaaataaaacgaaaggctcagtcgaaagactgggcctttcgttttagacttagggaccctttatgacaacttgacggctacatcattcactttttcttcacaaccggcacggaactcgctcgggctggccccggtgcattttttaaatacccgcgagaaatagagttgatcgtcaaaaccaacattgcgaccgacggtggcgataggcatccgggtggtgctcaaaagcagcttcgcctggctgatacgttggtcctcgcgccagcttaagacgctaatccctaactgctggcggaaaagatgtgacagacgcgacggcgacaagcaaacatgctgtgcgacgctggcgatatcaaaattgctgtctgccaggtgatcgctgatgtactgacaagcctcgcgtacccgattatccatcggtggatggagcgactcgttaatcgcttccatgcgccgcagtaacaattgctcaagcagatttatcgccagcagctccgaatagcgcccttccccttgcccggcgttaatgatttgcccaaacaggtcgctgaaatgcggctggtgcgcttcatccgggcgaaagaaccccgtattggcaaatattgacggccagttaagccattcatgccagtaggcgcgcggacgaaagtaaacccactggtgataccattcgcgagcctccggatgacgaccgtagtgatgaatctctcctggcgggaacagcaaaatatcacccggtcggcaaacaaattctcgtccctgatttttcaccaccccctgaccgcgaatggtgagattgagaatataacctttcattcccagcggtcggtcgataaaaaaatcgagataaccgttggcctcaatcggcgttaaacccgccaccagatgggcattaaacgagtatcccggcagcaggggatcattttgcgcttcagccatacttttcatactcccaccattcagagaagaaaccaattgtccatattgcatcagacattgccgtcactgcgtcttttactggctcttctcgctaacccaaccggtaaccccgcttattaaaagcattctgtaacaaagcgggaccaaagccatgacaaaaacgcgtaacaaaagtgtctataatcacggcagaaaagtccacattgattatttgcacggcgtcacactttgctatgccatagcatttttatccataagattagcggatcctacctgacgctttttatcgcaactctctactgtttctccatacccgtttttttggacgcgtacaactcaagtctgacataaatgaccgctatgagcactgcaattacacgccagatcgttctcgctaccgcaaccaccggtatgaaccagattggtgcgcactatgaaggccacaagatcattgagattggtgccgttgaagtggtgaaccgtcgcctgacgggcaataacttccatgtttatctcaaacccgatcggctggtggatccggaagcctttggcgtacatggtattgccgatgaatttttgctcgataagcccacgtttgccgaagtagccgatgagttcatggactatattcgcggcgcggagttggtgatccataacgcagcgttcgatatcggctttatggactacgagttttcgttgcttaagcgcgatattccgaagaccaatactttctgtaaggtcaccgatagccttgcggtggcgaggaaaatgtttcccggtaagcgcaacagcctcgatgcgttatgtgctcgctacgaaatagataacagtaaacgaacgctgcacggggcattactcgatgcccagatccttgcggaagtttatctggcgatgaccggtggtcaaacgtcgatggcttttgcgatggaaggagagacacaacagcaacaaggtgaagcaacaattcagcgcattgtacgtcaggcaagtaagttacgcgttgtttttgcgacagatgaagagattgcagctcatgaagcccgtctcgatctggtgcagaagaaaggcggaagttgcctctggcgagcataatttaatatcagtaaaccggacataacccatgaagaaaaatcgcgcttttttgaagtgggcagggggcaagtatcccctgcttgatgatattaaacggcatttgcccaagggcgaatgtctggttgagccttttgtaggtgccgggtcggtgtttctcaacaccgacttttctcgttatatccttgccgatatcaatagcgacctgatcagtctctataacattgtgaagatgcgtactgatgagtacgtacaggccgcacgcgagctgtttgttcccgaaacaaattgcgccgaggtttactatcagttccgcgaagagttcaacaaaagccaggatccgttccgtcgggcggtactgtttttatatttgaaccgctacggttacaacggcctgtgtcgttacaatctgcgcggtgagtttaacgtgccgttcggccgctacaaaaaaccctatttcccggaagcagagttgtatcacttcgctgaaaaagcgcagaatgcctttttctattgtgagtcttacgccgatagcatggcgcgcgcagatgatgcatccgtcgtctattgcgatccgccttatgcaccgctgtctgcgaccgccaactttacggcgtatcacacaaacagttttacgcttgaacaacaagcgcatctggcggagatcgccgaaggtctggttgagcgccatattccagtgctgatctccaatcacgatacgatgttaacgcgtgagtggtatcagcgcgcaaaattgcatgtcgtcaaagttcgacgcagtataagcagcaacggcggcacacgtaaaaaggtggacgaactgctggctttgtacaaaccaggagtcgtttcacccgcgaaaaaataattcagctaagacactgcactggattaagatgaaaacgattgaagttgatgatgaactctacagctatattgccagccacactaagcatatcggcgagagcgcatccgacattttacggcgtatgttgaaattttccgccgcatcacagcctgctgctccggtgacgaaagaggttcgcgttgcgtcacctgctatcgtcgaagcgaagccggtcaaaacgattaaagacaaggttcgcgcaatgcgtgaacttctgctttcggatgaatacgcagagcaaaagcgagcggtcaatcgctttatgctgctgttgtctacactatattctcttgacgcccaggcgtttgccgaagcaacggaatcgttgcacggtcgtacacgcgtttactttgcggcagatgaacaaacgctgctgaaaaatggtaatcagaccaagccgaaacatgtgccaggcacgccgtattgggtgatcaccaacaccaacaccggccgtaaatgcagcatgatcgaacacatcatgcagtcgatgcaattcccggcggaattgattgagaaggtttgcggaactatctaataatacaaaaattaggaggaatttcaacatgacaaatttatctgacatcattgaaaaagaaacaggaaaacaactagtgattcaagaatcaattctaatgttaccagaagaagtagaggaagtaattgggaataaaccagaaagtgatattttagttcatactgcttatgatgaaagtacagatgaaaatgtaatgctattaacttcagatgctccagaatataaaccttgggctttagtaattcaagacagtaatggagaaaataaaattaaaatgttataagtcgagattaagtaaaccggaatctgaagatgtcttctgaaaccggtccggttgcggttgacccgaccctgcgtcgtcgtatcgaaccgcacgaattcgaagttttcttcgacccgcgtgaactgcgtaaagaaacctgcctgctgtacgaaatcaactggggtggtcgtcactctatctggcgtcacacctctcagaacaccaacaaacacgttgaagttaacttcatcgaaaaattcaccaccgaacgttacttctgcccgaacacccgttgctctatcacctggttcctgtcttggtctccgtgcggtgaatgctctcgtgcgatcaccgaattcctgtctcgttacccgcacgttaccctgttcatctacatcgcgcgtctgtaccaccacgcggacccgcgtaaccgtcagggtctgcgtgacctgatctcttctggtgttaccatccagatcatgaccgaacaggaatctggttactgctggcgtaacttcgttaactactctccgtctaacgaagcgcactggccgcgttacccgcacctgtgggttcgtctgtacgttctggaactgtactgcatcatcctgggtctgccgccgtgcctgaacatcctgcgtcgtaaacagccgcagctgaccttcttcaccatcgcgctgcagtcttgccactaccagcgtctgccgccgcacatcctgtgggcgaccggtctgaaataaacttaattaacggcactcctcagccaagtcaaaagcctccgaccggaggcttttgactacatgcccatggcgtttacgccccgccctgccactcatcgcagtactgttgtaattcattaagcattctgccgacatggaagccatcacaaacggcatgatgaacctgaatcgccagcggcatcagcaccttgtcgccttgcgtataatatttgcccatagtgaaaacgggggcgaagaagttgtccatattggccacgtttaaatcaaaactggtgaaactcacccagggattggctgagacgaaaaacatattctcaataaaccctttagggaaataggccaggttttcaccgtaacacgccacatcttgcgaatatatgtgtagaaactgccggaaatcgtcgtggtattcactccagagcgatgaaaacgtttcagtttgctcatggaaaacggtgtaacaagggtgaacactatcccatatcaccagctcaccgtctttcattgccatacggaactccggatgagcattcatcaggcgggcaagaatgtgaataaaggccggataaaacttgtgcttatttttctttacggtctttaaaaaggccgtaatatccagctgaacggtctggttataggtacattgagtaactgactgaaatgcctcaaaatgttctttacgatgccattgggatatatcaacggtggtatatccagtgatttttttctccattttagcttccttagctcctgaaaatctcgataactcaaaaaatacgcccggtagtgatcttatttcattatggtgaaagttggaacctcttacgtgccaagccaaataggccgt

SEQ ID NO: 98 - DNA, 8861 bp, Artificial Sequence
  Synthetic Polynucleotide
cactcggtcgctacgctccgggcgtgagactgcggcgggcgctgcggacacatacaaagttacccacagattccgtggataagcaggggactaacatgtgaggcaaaacagcagggccgcgccggtggcgtttttccataggctccgccctcctgccagagttcacataaacagacgcttttccggtgcatctgtgggagccgtgaggctcaaccatgaatctgacagtacgggcgaaacccgacaggacttaaagatccccaccgtttccggcgggtcgctccctcttgcgctctcctgttccgaccctgccgtttaccggatacctgttccgcctttctcccttacgggaagtgtggcgctttctcatagctcacacactggtatctcggctcggtgtaggtcgttcgctccaagctgggctgtaagcaagaactccccgttcagcccgactgctgcgccttatccggtaactgttcacttgagtccaacccggaaaagcacggtaaaacgccactggcagcagccattggtaactgggagttcgcagaggatttgtttagctaaacacgcggttgctcttgaagtgtgcgccaaagtccggctacactggaaggacagatttggttgctgtgctctgcgaaagccagttaccacggttaagcagttccccaactgacttaaccttcgatcaaaccacctccccaggtggttttttcgtttacagggcaaaagattacgcgcagaaaaaaaggatctcaagaagatcctttgatcttttctactgaaccgctctagatttcagtgcaatttatctcttcaaatgtagcacctgaagtcagcccaggaggaagaggacatccggtcaaataaaacgaaaggctcagtcgaaagactgggcctttcgttttagacttagggaccctttatgacaacttgacggctacatcattcactttttcttcacaaccggcacggaactcgctcgggctggccccggtgcattttttaaatacccgcgagaaatagagttgatcgtcaaaaccaacattgcgaccgacggtggcgataggcatccgggtggtgctcaaaagcagcttcgcctggctgatacgttggtcctcgcgccagcttaagacgctaatccctaactgctggcggaaaagatgtgacagacgcgacggcgacaagcaaacatgctgtgcgacgctggcgatatcaaaattgctgtctgccaggtgatcgctgatgtactgacaagcctcgcgtacccgattatccatcggtggatggagcgactcgttaatcgcttccatgcgccgcagtaacaattgctcaagcagatttatcgccagcagctccgaatagcgcccttccccttgcccggcgttaatgatttgcccaaacaggtcgctgaaatgcggctggtgcgcttcatccgggcgaaagaaccccgtattggcaaatattgacggccagttaagccattcatgccagtaggcgcgcggacgaaagtaaacccactggtgataccattcgcgagcctccggatgacgaccgtagtgatgaatctctcctggcgggaacagcaaaatatcacccggtcggcaaacaaattctcgtccctgatttttcaccaccccctgaccgcgaatggtgagattgagaatataacctttcattcccagcggtcggtcgataaaaaaatcgagataaccgttggcctcaatcggcgttaaacccgccaccagatgggcattaaacgagtatcccggcagcaggggatcattttgcgcttcagccatacttttcatactcccaccattcagagaagaaaccaattgtccatattgcatcagacattgccgtcactgcgtcttttactggctcttctcgctaacccaaccggtaaccccgcttattaaaagcattctgtaacaaagcgggaccaaagccatgacaaaaacgcgtaacaaaagtgtctataatcacggcagaaaagtccacattgattatttgcacggcgtcacactttgctatgccatagcatttttatccataagattagcggatcctacctgacgctttttatcgcaactctctactgtttctccatacccgtttttttggacgcgtacaactcaagtctgacataaatgaccgctatgagcactgcaattacacgccagatcgttctcgctaccgcaaccaccggtatgaaccagattggtgcgcactatgaaggccacaagatcattgagattggtgccgttgaagtggtgaaccgtcgcctgacgggcaataacttccatgtttatctcaaacccgatcggctggtggatccggaagcctttggcgtacatggtattgccgatgaatttttgctcgataagcccacgtttgccgaagtagccgatgagttcatggactatattcgcggcgcggagttggtgatccataacgcagcgttcgatatcggctttatggactacgagttttcgttgcttaagcgcgatattccgaagaccaatactttctgtaaggtcaccgatagccttgcggtggcgaggaaaatgtttcccggtaagcgcaacagcctcgatgcgttatgtgctcgctacgaaatagataacagtaaacgaacgctgcacggggcattactcgatgcccagatccttgcggaagtttatctggcgatgaccggtggtcaaacgtcgatggcttttgcgatggaaggagagacacaacagcaacaaggtgaagcaacaattcagcgcattgtacgtcaggcaagtaagttacgcgttgtttttgcgacagatgaagagattgcagctcatgaagcccgtctcgatctggtgcagaagaaaggcggaagttgcctctggcgagcataatttaatatcagtaaaccggacataacccatgaagaaaaatcgcgcttttttgaagtgggcagggggcaagtatcccctgcttgatgatattaaacggcatttgcccaagggcgaatgtctggttgagccttttgtaggtgccgggtcggtgtttctcaacaccgacttttctcgttatatccttgccgatatcaatagcgacctgatcagtctctataacattgtgaagatgcgtactgatgagtacgtacaggccgcacgcgagctgtttgttcccgaaacaaattgcgccgaggtttactatcagttccgcgaagagttcaacaaaagccaggatccgttccgtcgggcggtactgtttttatatttgaaccgctacggttacaacggcctgtgtcgttacaatctgcgcggtgagtttaacgtgccgttcggccgctacaaaaaaccctatttcccggaagcagagttgtatcacttcgctgaaaaagcgcagaatgcctttttctattgtgagtcttacgccgatagcatggcgcgcgcagatgatgcatccgtcgtctattgcgatccgccttatgcaccgctgtctgcgaccgccaactttacggcgtatcacacaaacagttttacgcttgaacaacaagcgcatctggcggagatcgccgaaggtctggttgagcgccatattccagtgctgatctccaatcacgatacgatgttaacgcgtgagtggtatcagcgcgcaaaattgcatgtcgtcaaagttcgacgcagtataagcagcaacggcggcacacgtaaaaaggtggacgaactgctggctttgtacaaaccaggagtcgtttcacccgcgaaaaaataattcagctaagacactgcactggattaagatgaaaacgattgaagttgatgatgaactctacagctatattgccagccacactaagcatatcggcgagagcgcatccgacattttacggcgtatgttgaaattttccgccgcatcacagcctgctgctccggtgacgaaagaggttcgcgttgcgtcacctgctatcgtcgaagcgaagccggtcaaaacgattaaagacaaggttcgcgcaatgcgtgaacttctgctttcggatgaatacgcagagcaaaagcgagcggtcaatcgctttatgctgctgttgtctacactatattctcttgacgcccaggcgtttgccgaagcaacggaatcgttgcacggtcgtacacgcgtttactttgcggcagatgaacaaacgctgctgaaaaatggtaatcagaccaagccgaaacatgtgccaggcacgccgtattgggtgatcaccaacaccaacaccggccgtaaatgcagcatgatcgaacacatcatgcagtcgatgcaattcccggcggaattgattgagaaggtttgcggaactatctaaaagaattccaaaaacaggtacgacatacatgaatcagaatctgctggtgacaaagcgcgacggtagcacagagcgcatcaatctcgacaaaatccatcgcgttctggattgggcggcagaaggactgcataacgtttcgatttcccaggtcgagctgcgctcccacattcagttttatgacggtatcaagacctctgacatccacgaaaccattatcaaggctgccgcagacctgatctcccgtgatgcgccggattatcagtatctcgccgcgcgcctggcgatcttccacctgcgtaaaaaagcctacggccagtttgagccgcctgcgctgtacgaccacgtggtgaaaatggtcgagatgggcaaatacgataatcatctgctggaagactacacggaagaagagttcaagcagatggacacctttatcgatcacgaccgtgatatgaccttctcttatgctgccgttaagcagctggaaggcaaatatctggtacagaaccgcgtgaccggcgaaatctatgagagcgcccagttcctttatattctagttgccgcgtgcttgttctcgaactacccgcgtgaaacgcgcctgcaatatgtgaagcgtttttacgacgcggtttccacatttaaaatttcgctgccgacgccaatcatgtccggcgtgcgtaccccgactcgtcagttcagctcctgcgtactgatcgagtgcggtgacagcctggattccatcaacgccacctccagcgcgattgttaaatacgtttcccagcgtgccgggatcggcatcaacgccgggcgtattcgtgcgctgggtagcccgattcgcggtggtgaagcgttccataccggctgcattccgttctacaaacatttccagacagcggtgaaatcctgctctcagggcggtgtgcgcggcggtgcggcaacgctgttctacccgatgtggcatctggaagtggaaagcctgctggtgttgaaaaacaaccgtggtgtggaaggcaaccgcgtgcgtcatatggactacggggtacaaatcaacaaactgatgtatacccgtctgctgaaaggtgaagatatcaccctgttcagcccgtccgacgtaccggggctgtacgacgcgttcttcgccgatcaggaagagtttgaacgtctgtataccaaatatgagaaagacgacagcatccgcaagcagcgtgtgaaagccgttgagctgttctcgctgatgatgcaggaacgtgcgtctaccggtcgtatctatattcagaacgttgaccactgcaatacccatagcccgtttgatccggccatcgcgccagtgcgtcagtctaacctgtgcctggagatagccctgccgaccaaaccgctgaacgacgtcaacgacgagaacggtgaaatcgcgctgtgtacgctgtctgctttcaacctgggcgcaattaataacctggatgaactggaagagctggcaattctggcggttcgtgcacttgacgcgctgctggattatcaggattacccgatcccggccgccaaacgtggagcgatgggtcgtcgtacgctgggtattggtgtgatcaacttcgcttactacctggcgaagcacggtaaacgctactccgacggcagcgccaacaacctgacgcataaaaccttcgaagccattcagtattacctgctgaaagcctctaatgagctggcgaaagagcaaggcgcgtgcccgtggtttaacgaaaccacttacgcgaaagggatcctgccgatcgatacctataagaaagatctggataccatcgctaatgagccgctgcattacgactgggaagctctgcgtgagtcaatcaaaacgcacggtctgcgtaactccacgctttctgctctgatgccgtccgagacttcttcgcagatctctaacgccactaacggtattgaaccgccgcgcggttacgtcagcatcaaagcgtcgaaagacggtattttgcgccaggtggtgccggactacgagcacctgcacgacgcctatgagctgctgtgggaaatgccgggtaacgatggttatctgcaactggtgggtatcatgcagaaatttatcgatcagtcgatctctgccaacaccaactacgatccgtcacgcttcccgtcaggaaaagtgccgatgcagcagttgctgaaagacctgctcaccgcctacaaattcggggtcaaaacactgtattatcagaacacccgtgacggcgctgaagacgcacaagacgatctggtgccgtcaatccaggacgatggctgcgaaagcggcgcatgtaagatctgatattgagatgccggatgcggcgtaaacgccttatccggcctacggctcggtttgtaggcctgataagacgcgccagcgtcgcatcaggctccgggtgccggatgcagcgtgaacgccttatccggcctacggctcggatttgtaggcctgataagacgcgccagcgtcgcatcaggcacaggatgcggcgtaaaatgccttatccggcattaaactcccaacaggacacactcatggcatataccaccttttcacagacgaaaaatgatcagctcaaagaaccgatgttctttggtcagccggtcaacgtggctcgctacgatcagcaaaaatatgacatcttcgaaaagctgatcgaaaagcagctctctttcttctggcgtccggaagaagttgacgtctcccgcgaccgtatagattaccaggcgctgccggagcacgaaaaacacatctttatcagcaacctgaaatatcagacgctgctggattccattcagggtcgtagcccgaacgtggcgctattgccgcttatttctattccggaactggaaacctgggtcgaaacctgggcgttctcagaaacgattcattcccgttcctatactcatatcattcgtaatatcgttaacgatccgtctgttgtgtttgacgatatcgtcaccaacgagcagatccagaaacgtgcggaagggatctccagctattacgatgagctgatcgaaatgaccagctactggcatctgctgggcgaaggtacccacaccgttaacggtaaaactgtgaccgttagcctgcgcgagctgaagaaaaaactgtatctctgcctgatgagcgttaacgcgctggaagcgattcgtttctacgtcagctttgcttgttccttcgcatttgcagaacgcgaattgatggaaggcaacgccaaaattattcgcctgattgcccgcgacgaagccctgcacctgaccggcacccagcatatgctgaatctgctgcgcagcggcgcggacgatcctgagatggcggaaattgccgaagagtgtaagcaggagtgctatgacctgtttgttcaggcagctcaacaggagaaagactgggcggattatctgttccgcgacggttcgatgattggtctgaataaagacattctctgccagtacgttgaatacatcaccaatatccgtatgcaggcagtcggtttggatctgccgttccagacgcgctccaacccgatcccgtggatcaacacttggctggtgtctgataacgtgcaggttgctccgcaggaagtggaagtcagttcttatctggtcgggcagattgactcggaagtggacaccgacgatttgagtaacttccagctctgaacttaattaacggcactcctcagccaagtcaaaagcctccgaccggaggcttttgactacatgcccatggcgtttacgccccgccctgccactcatcgcagtactgttgtaattcattaagcattctgccgacatggaagccatcacaaacggcatgatgaacctgaatcgccagcggcatcagcaccttgtcgccttgcgtataatatttgcccatagtgaaaacgggggcgaagaagttgtccatattggccacgtttaaatcaaaactggtgaaactcacccagggattggctgagacgaaaaacatattctcaataaaccctttagggaaataggccaggttttcaccgtaacacgccacatcttgcgaatatatgtgtagaaactgccggaaatcgtcgtggtattcactccagagcgatgaaaacgtttcagtttgctcatggaaaacggtgtaacaagggtgaacactatcccatatcaccagctcaccgtctttcattgccatacggaactccggatgagcattcatcaggcgggcaagaatgtgaataaaggccggataaaacttgtgcttatttttctttacggtctttaaaaaggccgtaatatccagctgaacggtctggttataggtacattgagtaactgactgaaatgcctcaaaatgttctttacgatgccattgggatatatcaacggtggtatatccagtgatttttttctccattttagcttccttagctcctgaaaatctcgataactcaaaaaatacgcccggtagtgatcttatttcattatggtgaaagttggaacctcttacgtgccaagccaaataggccgt

SEQ ID NO: 99 - DNA, 8861 bp, Artificial Sequence
  Synthetic Polynucleotide
cactcggtcgctacgctccgggcgtgagactgcggcgggcgctgcggacacatacaaagttacccacagattccgtggataagcaggggactaacatgtgaggcaaaacagcagggccgcgccggtggcgtttttccataggctccgccctcctgccagagttcacataaacagacgcttttccggtgcatctgtgggagccgtgaggctcaaccatgaatctgacagtacgggcgaaacccgacaggacttaaagatccccaccgtttccggcgggtcgctccctcttgcgctctcctgttccgaccctgccgtttaccggatacctgttccgcctttctcccttacgggaagtgtggcgctttctcatagctcacacactggtatctcggctcggtgtaggtcgttcgctccaagctgggctgtaagcaagaactccccgttcagcccgactgctgcgccttatccggtaactgttcacttgagtccaacccggaaaagcacggtaaaacgccactggcagcagccattggtaactgggagttcgcagaggatttgtttagctaaacacgcggttgctcttgaagtgtgcgccaaagtccggctacactggaaggacagatttggttgctgtgctctgcgaaagccagttaccacggttaagcagttccccaactgacttaaccttcgatcaaaccacctccccaggtggttttttcgtttacagggcaaaagattacgcgcagaaaaaaaggatctcaagaagatcctttgatcttttctactgaaccgctctagatttcagtgcaatttatctcttcaaatgtagcacctgaagtcagcccaggaggaagaggacatccggtcaaataaaacgaaaggctcagtcgaaagactgggcctttcgttttagacttagggaccctttatgacaacttgacggctacatcattcactttttcttcacaaccggcacggaactcgctcgggctggccccggtgcattttttaaatacccgcgagaaatagagttgatcgtcaaaaccaacattgcgaccgacggtggcgataggcatccgggtggtgctcaaaagcagcttcgcctggctgatacgttggtcctcgcgccagcttaagacgctaatccctaactgctggcggaaaagatgtgacagacgcgacggcgacaagcaaacatgctgtgcgacgctggcgatatcaaaattgctgtctgccaggtgatcgctgatgtactgacaagcctcgcgtacccgattatccatcggtggatggagcgactcgttaatcgcttccatgcgccgcagtaacaattgctcaagcagatttatcgccagcagctccgaatagcgcccttccccttgcccggcgttaatgatttgcccaaacaggtcgctgaaatgcggctggtgcgcttcatccgggcgaaagaaccccgtattggcaaatattgacggccagttaagccattcatgccagtaggcgcgcggacgaaagtaaacccactggtgataccattcgcgagcctccggatgacgaccgtagtgatgaatctctcctggcgggaacagcaaaatatcacccggtcggcaaacaaattctcgtccctgatttttcaccaccccctgaccgcgaatggtgagattgagaatataacctttcattcccagcggtcggtcgataaaaaaatcgagataaccgttggcctcaatcggcgttaaacccgccaccagatgggcattaaacgagtatcccggcagcaggggatcattttgcgcttcagccatacttttcatactcccaccattcagagaagaaaccaattgtccatattgcatcagacattgccgtcactgcgtcttttactggctcttctcgctaacccaaccggtaaccccgcttattaaaagcattctgtaacaaagcgggaccaaagccatgacaaaaacgcgtaacaaaagtgtctataatcacggcagaaaagtccacattgattatttgcacggcgtcacactttgctatgccatagcatttttatccataagattagcggatcctacctgacgctttttatcgcaactctctactgtttctccatacccgtttttttggacgcgtacaactcaagtctgacataaatgaccgctatgagcactgcaattacacgccagatcgttctcgctaccgcaaccaccggtatgaaccagattggtgcgcactatgaaggccacaagatcattgagattggtgccgttgaagtggtgaaccgtcgcctgacgggcaataacttccatgtttatctcaaacccgatcggctggtggatccggaagcctttggcgtacatggtattgccgatgaatttttgctcgataagcccacgtttgccgaagtagccgatgagttcatggactatattcgcggcgcggagttggtgatccataacgcagcgttcgatatcggctttatggactacgagttttcgttgcttaagcgcgatattccgaagaccaatactttctgtaaggtcaccgatagccttgcggtggcgaggaaaatgtttcccggtaagcgcaacagcctcgatgcgttatgtgctcgctacgaaatagataacagtaaacgaacgctgcacggggcattactcgatgcccagatccttgcggaagtttatctggcgatgaccggtggtcaaacgtcgatggcttttgcgatggaaggagagacacaacagcaacaaggtgaagcaacaattcagcgcattgtacgtcaggcaagtaagttacgcgttgtttttgcgacagatgaagagattgcagctcatgaagcccgtctcgatctggtgcagaagaaaggcggaagttgcctctggcgagcataatttaatatcagtaaaccggacataacccatgaagaaaaatcgcgcttttttgaagtgggcagggggcaagtatcccctgcttgatgatattaaacggcatttgcccaagggcgaatgtctggttgagccttttgtaggtgccgggtcggtgtttctcaacaccgacttttctcgttatatccttgccgatatcaatagcgacctgatcagtctctataacattgtgaagatgcgtactgatgagtacgtacaggccgcacgcgagctgtttgttcccgaaacaaattgcgccgaggtttactatcagttccgcgaagagttcaacaaaagccaggatccgttccgtcgggcggtactgtttttatatttgaaccgctacggttacaacggcctgtgtcgttacaatctgcgcggtgagtttaacgtgccgttcggccgctacaaaaaaccctatttcccggaagcagagttgtatcacttcgctgaaaaagcgcagaatgcctttttctattgtgagtcttacgccgatagcatggcgcgcgcagatgatgcatccgtcgtctattgcgatccgccttatgcaccgctgtctgcgaccgccaactttacggcgtatcacacaaacagttttacgcttgaacaacaagcgcatctggcggagatcgccgaaggtctggttgagcgccatattccagtgctgatctccaatcacgatacgatgttaacgcgtgagtggtatcagcgcgcaaaattgcatgtcgtcaaagttcgacgcagtataagcagcaacggcggcacacgtaaaaaggtggacgaactgctggctttgtacaaaccaggagtcgtttcacccgcgaaaaaataattcagctaagacactgcactggattaagatgaaaacgattgaagttgatgatgaactctacagctatattgccagccacactaagcatatcggcgagagcgcatccgacattttacggcgtatgttgaaattttccgccgcatcacagcctgctgctccggtgacgaaagaggttcgcgttgcgtcacctgctatcgtcgaagcgaagccggtcaaaacgattaaagacaaggttcgcgcaatgcgtgaacttctgctttcggatgaatacgcagagcaaaagcgagcggtcaatcgctttatgctgctgttgtctacactatattctcttgacgcccaggcgtttgccgaagcaacggaatcgttgcacggtcgtacacgcgtttactttgcggcagatgaacaaacgctgctgaaaaatggtaatcagaccaagccgaaacatgtgccaggcacgccgtattgggtgatcaccaacaccaacaccggccgtaaatgcagcatgatcgaacacatcatgcagtcgatgcaattcccggcggaattgattgagaaggtttgcggaactatctaaaagaattccaaaaacaggtacgacatacatgaatcagaatctgctggtgacaaagcgcgacggtagcacagagcgcatcaatctcgacaaaatccatcgcgttctggattgggcggcagaaggactgcataacgtttcgatttcccaggtcgagctgcgctcccacattcagttttatgacggtatcaagacctctgacatcgcggaaaccattatcaaggctgccgcagacctgatctcccgtgatgcgccggattatcagtatctcgccgcgcgcctggcgatcttccacctgcgtaaaaaagcctacggccagtttgagccgcctgcgctgtacgaccacgtggtgaaaatggtcgagatgggcaaatacgataatcatctgctggaagactacacggaagaagagttcaagcagatggacacctttatcgatcacgaccgtgatatgaccttctcttatgctgccgttaagcagctggaaggcaaatatctggtacagaaccgcgtgaccggcgaaatctatgagagcgcccagttcctttatattctagttgccgcgtgcttgttctcgaactacccgcgtgaaacgcgcctgcaatatgtgaagcgtttttacgacgcggtttccacatttaaaatttcgctgccgacgccaatcatgtccggcgtgcgtaccccgactcgtcagttcagctcctgcgtactgatcgagtgcggtgacagcctggattccatcaacgccacctccagcgcgattgttaaatacgtttcccagcgtgccgggatcggcatcaacgccgggcgtattcgtgcgctgggtagcccgattcgcggtggtgaagcgttccataccggctgcattccgttctacaaacatttccagacagcggtgaaatcctgctctcagggcggtgtgcgcggcggtgcggcaacgctgttctacccgatgtggcatctggaagtggaaagcctgctggtgttgaaaaacaaccgtggtgtggaaggcaaccgcgtgcgtcatatggactacggggtacaaatcaacaaactgatgtatacccgtctgctgaaaggtgaagatatcaccctgttcagcccgtccgacgtaccggggctgtacgacgcgttcttcgccgatcaggaagagtttgaacgtctgtataccaaatatgagaaagacgacagcatccgcaagcagcgtgtgaaagccgttgagctgttctcgctgatgatgcaggaacgtgcgtctaccggtcgtatctatattcagaacgttgaccactgcaatacccatagcccgtttgatccggccatcgcgccagtgcgtcagtctaacctgtgcctggagatagccctgccgaccaaaccgctgaacgacgtcaacgacgagaacggtgaaatcgcgctgtgtacgctgtctgctttcaacctgggcgcaattaataacctggatgaactggaagagctggcaattctggcggttcgtgcacttgacgcgctgctggattatcaggattacccgatcccggccgccaaacgtggagcgatgggtcgtcgtacgctgggtattggtgtgatcaacttcgcttactacctggcgaagcacggtaaacgctactccgacggcagcgccaacaacctgacgcataaaaccttcgaagccattcagtattacctgctgaaagcctctaatgagctggcgaaagagcaaggcgcgtgcccgtggtttaacgaaaccacttacgcgaaagggatcctgccgatcgatacctataagaaagatctggataccatcgctaatgagccgctgcattacgactgggaagctctgcgtgagtcaatcaaaacgcacggtctgcgtaactccacgctttctgctctgatgccgtccgagacttcttcgcagatctctaacgccactaacggtattgaaccgccgcgcggttacgtcagcatcaaagcgtcgaaagacggtattttgcgccaggtggtgccggactacgagcacctgcacgacgcctatgagctgctgtgggaaatgccgggtaacgatggttatctgcaactggtgggtatcatgcagaaatttatcgatcagtcgatctctgccaacaccaactacgatccgtcacgcttcccgtcaggaaaagtgccgatgcagcagttgctgaaagacctgctcaccgcctacaaattcggggtcaaaacactgtattatcagaacacccgtgacggcgctgaagacgcacaagacgatctggtgccgtcaatccaggacgatggctgcgaaagcggcgcatgtaagatctgatattgagatgccggatgcggcgtaaacgccttatccggcctacggctcggtttgtaggcctgataagacgcgccagcgtcgcatcaggctccgggtgccggatgcagcgtgaacgccttatccggcctacggctcggatttgtaggcctgataagacgcgccagcgtcgcatcaggcacaggatgcggcgtaaaatgccttatccggcattaaactcccaacaggacacactcatggcatataccaccttttcacagacgaaaaatgatcagctcaaagaaccgatgttctttggtcagccggtcaacgtggctcgctacgatcagcaaaaatatgacatcttcgaaaagctgatcgaaaagcagctctctttcttctggcgtccggaagaagttgacgtctcccgcgaccgtatagattaccaggcgctgccggagcacgaaaaacacatctttatcagcaacctgaaatatcagacgctgctggattccattcagggtcgtagcccgaacgtggcgctattgccgcttatttctattccggaactggaaacctgggtcgaaacctgggcgttctcagaaacgattcattcccgttcctatactcatatcattcgtaatatcgttaacgatccgtctgttgtgtttgacgatatcgtcaccaacgagcagatccagaaacgtgcggaagggatctccagctattacgatgagctgatcgaaatgaccagctactggcatctgctgggcgaaggtacccacaccgttaacggtaaaactgtgaccgttagcctgcgcgagctgaagaaaaaactgtatctctgcctgatgagcgttaacgcgctggaagcgattcgtttctacgtcagctttgcttgttccttcgcatttgcagaacgcgaattgatggaaggcaacgccaaaattattcgcctgattgcccgcgacgaagccctgcacctgaccggcacccagcatatgctgaatctgctgcgcagcggcgcggacgatcctgagatggcggaaattgccgaagagtgtaagcaggagtgctatgacctgtttgttcaggcagctcaacaggagaaagactgggcggattatctgttccgcgacggttcgatgattggtctgaataaagacattctctgccagtacgttgaatacatcaccaatatccgtatgcaggcagtcggtttggatctgccgttccagacgcgctccaacccgatcccgtggatcaacacttggctggtgtctgataacgtgcaggttgctccgcaggaagtggaagtcagttcttatctggtcgggcagattgactcggaagtggacaccgacgatttgagtaacttccagctctgaacttaattaacggcactcctcagccaagtcaaaagcctccgaccggaggcttttgactacatgcccatggcgtttacgccccgccctgccactcatcgcagtactgttgtaattcattaagcattctgccgacatggaagccatcacaaacggcatgatgaacctgaatcgccagcggcatcagcaccttgtcgccttgcgtataatatttgcccatagtgaaaacgggggcgaagaagttgtccatattggccacgtttaaatcaaaactggtgaaactcacccagggattggctgagacgaaaaacatattctcaataaaccctttagggaaataggccaggttttcaccgtaacacgccacatcttgcgaatatatgtgtagaaactgccggaaatcgtcgtggtattcactccagagcgatgaaaacgtttcagtttgctcatggaaaacggtgtaacaagggtgaacactatcccatatcaccagctcaccgtctttcattgccatacggaactccggatgagcattcatcaggcgggcaagaatgtgaataaaggccggataaaacttgtgcttatttttctttacggtctttaaaaaggccgtaatatccagctgaacggtctggttataggtacattgagtaactgactgaaatgcctcaaaatgttctttacgatgccattgggatatatcaacggtggtatatccagtgatttttttctccattttagcttccttagctcctgaaaatctcgataactcaaaaaatacgcccggtagtgatcttatttcattatggtgaaagttggaacctcttacgtgccaagccaaataggccgt

SEQ ID NO: 100 - DNA, 6092 bp, Artificial Sequence
  Synthetic Polynucleotide
cactcggtcgctacgctccgggcgtgagactgcggcgggcgctgcggacacatacaaagttacccacagattccgtggataagcaggggactaacatgtgaggcaaaacagcagggccgcgccggtggcgtttttccataggctccgccctcctgccagagttcacataaacagacgcttttccggtgcatctgtgggagccgtgaggctcaaccatgaatctgacagtacgggcgaaacccgacaggacttaaagatccccaccgtttccggcgggtcgctccctcttgcgctctcctgttccgaccctgccgtttaccggatacctgttccgcctttctcccttacgggaagtgtggcgctttctcatagctcacacactggtatctcggctcggtgtaggtcgttcgctccaagctgggctgtaagcaagaactccccgttcagcccgactgctgcgccttatccggtaactgttcacttgagtccaacccggaaaagcacggtaaaacgccactggcagcagccattggtaactgggagttcgcagaggatttgtttagctaaacacgcggttgctcttgaagtgtgcgccaaagtccggctacactggaaggacagatttggttgctgtgctctgcgaaagccagttaccacggttaagcagttccccaactgacttaaccttcgatcaaaccacctccccaggtggttttttcgtttacagggcaaaagattacgcgcagaaaaaaaggatctcaagaagatcctttgatcttttctactgaaccgctctagatttcagtgcaatttatctcttcaaatgtagcacctgaagtcagcccaggaggaagaggacatccggtcaaataaaacgaaaggctcagtcgaaagactgggcctttcgttttagacttagggaccctttatgacaacttgacggctacatcattcactttttcttcacaaccggcacggaactcgctcgggctggccccggtgcattttttaaatacccgcgagaaatagagttgatcgtcaaaaccaacattgcgaccgacggtggcgataggcatccgggtggtgctcaaaagcagcttcgcctggctgatacgttggtcctcgcgccagcttaagacgctaatccctaactgctggcggaaaagatgtgacagacgcgacggcgacaagcaaacatgctgtgcgacgctggcgatatcaaaattgctgtctgccaggtgatcgctgatgtactgacaagcctcgcgtacccgattatccatcggtggatggagcgactcgttaatcgcttccatgcgccgcagtaacaattgctcaagcagatttatcgccagcagctccgaatagcgcccttccccttgcccggcgttaatgatttgcccaaacaggtcgctgaaatgcggctggtgcgcttcatccgggcgaaagaaccccgtattggcaaatattgacggccagttaagccattcatgccagtaggcgcgcggacgaaagtaaacccactggtgataccattcgcgagcctccggatgacgaccgtagtgatgaatctctcctggcgggaacagcaaaatatcacccggtcggcaaacaaattctcgtccctgatttttcaccaccccctgaccgcgaatggtgagattgagaatataacctttcattcccagcggtcggtcgataaaaaaatcgagataaccgttggcctcaatcggcgttaaacccgccaccagatgggcattaaacgagtatcccggcagcaggggatcattttgcgcttcagccatacttttcatactcccaccattcagagaagaaaccaattgtccatattgcatcagacattgccgtcactgcgtcttttactggctcttctcgctaacccaaccggtaaccccgcttattaaaagcattctgtaacaaagcgggaccaaagccatgacaaaaacgcgtaacaaaagtgtctataatcacggcagaaaagtccacattgattatttgcacggcgtcacactttgctatgccatagcatttttatccataagattagcggatcctacctgacgctttttatcgcaactctctactgtttctccatacccgtttttttggacgcgtacaactcaagtctgacataaatgaccgctatgagcactgcaattacacgccagatcgttctcgctaccgcaaccaccggtatgaaccagatcggtgcgcactatgaaggccacaagatcattgagattggtgccgttgaagtggtgaaccgtcgcctgacgggcaacaacttccatgtttatctcaaacccgatcggctggtggatccggaagcctttggcgtacatggtattgccgatgaatttttgctcgataagcccacgtttgccgaagtagccgatgagttcatggactatattcgcggcgcggagttggtgatccataacgcagcgttcgatatcggctttatggactacgagttttcgttgcttaagcgcgatattccgaagaccaatactttctgtaaggtcaccgatagccttgcggtggcgaggaaaatgtttcccggtaagcgcaacagcctcgatgcgttatgtgctcgctacgaaatagataacagtaaacgaacgctgcacggggcattactcgatgcccagatccttgcggaagtttatctggcgatgaccggtggtcaaacgtcgatggcttttgcgatggaaggagagacacaacagcaacaaggtgaagcaacaattcagcgcattgtacgtcaggcaagtaagttacgcgttgtttttgcgacagatgaagagattgcagctcatgaagcccgtctcgatctggtgcagaagaaaggcggaagttgcctctggcgagcataattcaacatcagtaaaccggacataacccatgaagaaaaatcgcgcttttttgaagtgggcagggggcaagtatcccctgcttgatgatattaaacggcatttgcccaagggcgaatgtctggttgagccttttgtaggtgccgggtcggtgtttctcaacaccgacttttctcgttacatccttgccgatatcaatagcgacctgatcagtctctataacattgtgaagatgcgtactgatgagtacgtacaggccgcacgcgagctgtttgttcccgaaacaaattgcgccgaggtttactatcagttccgcgaagagttcaacaaaagccaggatccgttccgtcgggcggtactgttcttatatttgaaccgctacggttacaacggcctgtgtcgttacaatctgcgcggtgagtttaacgtgccgttcggccgctacaaaaaaccctatttcccggaagcagagttgtatcacttcgctgaaaaagcgcagaacgcctttttctattgtgagtcttacgccgacagcatggcgcgcgcagatgatgcatccgtcgtctattgcgatccgccttatgcaccgctgtctgcgaccgccaactttacggcgtatcacacaaacagttttacgcttgaacaacaagcgcatctggcggagatcgccgaaggtctggttgagcgccatattccagtgctgatctccaatcacgatacgatgttaacgcgtgagtggtatcagcgcgcgaagctgcatgtcgtcaaagttcgacgcagcataagcagcaacggcggcacacgtaaaaaggtggacgaactgctggctttgtacaaaccaggagtcgtttcacccgcgaaaaaataattcagctaagacactgcactggattaagatgaaaacgatcgaagttgatgacgaactctacagctatatcgccagccacactaagcatatcggcgagagcgcatccgacattttacggcgtatgttgaaattttccgccgcatcacagcctgctgctccggtgacgaaagaggttcgcgttgcgtcacctgctatcgtcgaagcgaagccggtcaaaacgattaaagacaaggttcgcgcaatgcgtgaacttctgctttcggatgaatacgcagagcaaaagcgagcggtcaatcgctttatgctgctgttgtctacactatattctcttgacgcccaggcgtttgccgaagcaacggaatcgttgcacggtcgtacacgcgtttactttgcggcagatgaacaaacgctgctgaaaaacggtaatcagaccaagccgaaacatgtgccaggcacgccgtattgggtgatcaccaacaccaacaccggccgtaaatgcagcatgatcgaacacatcatgcagtcgatgcaattcccggcggaactgattgagaaggtttgcggaactatctaataatacaaaaactaggaggaacttcaacatgacaaatttatctgacatcattgaaaaagaaacaggaaaacaactagtgattcaagaatcaattctaatgttaccagaagaagtagaggaagtaatcgggaataaaccagaaagtgatattttagttcatactgcttatgacgaaagtacagatgaaaacgtaatgctattaacttcagatgctccagaatacaaaccttgggcgttagtaattcaagacagtaatggagaaaacaagattaaaatgttgtaagtcgagattaagtaaaccggaatctgaagatggactctctgctgatgaaccgtcgcaaattcctgtaccagttcaaaaacgttcgttgggcgaaaggtcgtcgtgaaacctacctgtgctacgttgttaaacgtcgtgactctgcgacctctttctctctggacttcggttacctgcgtaacaaaaacggttgccacgttgaactgctgttcctgcgttacatctctgactgggacctggacccgggtcgttgctaccgtgttacctggttcacctcttggtctccgtgctacgactgcgcgcgtcacgttgcggacttcctgcgtggtaacccgaacctgtctctgcgtatcttcaccgcgcgtctgtacttctgcgaagaccgtaaagcggaaccggaaggtctgcgtcgtctgcaccgtgcgggtgttcagatcgcgatcatgaccttcaaagactacttctactgctggaacaccttcgttgaaaaccacgaacgtaccttcaaagcgtgggaaggtctacacgaaaactctgttcgtctgtctcgtcagctgcgtcgtatcctgctgccgctgtacgaagttgacgacctgcgtgacgcgttccgtaccctgggtctgtaaacttaattaacggcactcctcagccaagtcaaaagcctccgaccggaggcttttgactacatgcccatggcgtttacgccccgccctgccactcatcgcagtactgttgtaattcattaagcattctgccgacatggaagccatcacaaacggcatgatgaacctgaatcgccagcggcatcagcaccttgtcgccttgcgtataatatttgcccatagtgaaaacgggggcgaagaagttgtccatattggccacgtttaaatcaaaactggtgaaactcacccagggattggctgagacgaaaaacatattctcaataaaccctttagggaaataggccaggttttcaccgtaacacgccacatcttgcgaatatatgtgtagaaactgccggaaatcgtcgtggtattcactccagagcgatgaaaacgtttcagtttgctcatggaaaacggtgtaacaagggtgaacactatcccatatcaccagctcaccgtctttcattgccatacggaactccggatgagcattcatcaggcgggcaagaatgtgaataaaggccggataaaacttgtgcttatttttctttacggtctttaaaaaggccgtaatatccagctgaacggtctggttataggtacattgagtaactgactgaaatgcctcaaaatgttctttacgatgccattgggatatatcaacggtggtatatccagtgatttttttctccattttagcttccttagctcctgaaaatctcgataactcaaaaaatacgcccggtagtgatcttatttcattatggtgaaagttggaacctcttacgtgccaagccaaataggccgt

SEQ ID NO: 101 - DNA, 6185 bp, Artificial Sequence
  Synthetic Polynucleotide
cactcggtcgctacgctccgggcgtgagactgcggcgggcgctgcggacacatacaaagttacccacagattccgtggataagcaggggactaacatgtgaggcaaaacagcagggccgcgccggtggcgtttttccataggctccgccctcctgccagagttcacataaacagacgcttttccggtgcatctgtgggagccgtgaggctcaaccatgaatctgacagtacgggcgaaacccgacaggacttaaagatccccaccgtttccggcgggtcgctccctcttgcgctctcctgttccgaccctgccgtttaccggatacctgttccgcctttctcccttacgggaagtgtggcgctttctcatagctcacacactggtatctcggctcggtgtaggtcgttcgctccaagctgggctgtaagcaagaactccccgttcagcccgactgctgcgccttatccggtaactgttcacttgagtccaacccggaaaagcacggtaaaacgccactggcagcagccattggtaactgggagttcgcagaggatttgtttagctaaacacgcggttgctcttgaagtgtgcgccaaagtccggctacactggaaggacagatttggttgctgtgctctgcgaaagccagttaccacggttaagcagttccccaactgacttaaccttcgatcaaaccacctccccaggtggttttttcgtttacagggcaaaagattacgcgcagaaaaaaaggatctcaagaagatcctttgatcttttctactgaaccgctctagatttcagtgcaatttatctcttcaaatgtagcacctgaagtcagcccaggaggaagaggacatccggtcaaataaaacgaaaggctcagtcgaaagactgggcctttcgttttagacttagggaccctttatgacaacttgacggctacatcattcactttttcttcacaaccggcacggaactcgctcgggctggccccggtgcattttttaaatacccgcgagaaatagagttgatcgtcaaaaccaacattgcgaccgacggtggcgataggcatccgggtggtgctcaaaagcagcttcgcctggctgatacgttggtcctcgcgccagcttaagacgctaatccctaactgctggcggaaaagatgtgacagacgcgacggcgacaagcaaacatgctgtgcgacgctggcgatatcaaaattgctgtctgccaggtgatcgctgatgtactgacaagcctcgcgtacccgattatccatcggtggatggagcgactcgttaatcgcttccatgcgccgcagtaacaattgctcaagcagatttatcgccagcagctccgaatagcgcccttccccttgcccggcgttaatgatttgcccaaacaggtcgctgaaatgcggctggtgcgcttcatccgggcgaaagaaccccgtattggcaaatattgacggccagttaagccattcatgccagtaggcgcgcggacgaaagtaaacccactggtgataccattcgcgagcctccggatgacgaccgtagtgatgaatctctcctggcgggaacagcaaaatatcacccggtcggcaaacaaattctcgtccctgatttttcaccaccccctgaccgcgaatggtgagattgagaatataacctttcattcccagcggtcggtcgataaaaaaatcgagataaccgttggcctcaatcggcgttaaacccgccaccagatgggcattaaacgagtatcccggcagcaggggatcattttgcgcttcagccatacttttcatactcccaccattcagagaagaaaccaattgtccatattgcatcagacattgccgtcactgcgtcttttactggctcttctcgctaacccaaccggtaaccccgcttattaaaagcattctgtaacaaagcgggaccaaagccatgacaaaaacgcgtaacaaaagtgtctataatcacggcagaaaagtccacattgattatttgcacggcgtcacactttgctatgccatagcatttttatccataagattagcggatcctacctgacgctttttatcgcaactctctactgtttctccatacccgtttttttggacgcgtacaactcaagtctgacataaatgaccgctatgagcactgcaattacacgccagatcgttctcgctaccgcaaccaccggtatgaaccagatcggtgcgcactatgaaggccacaagatcattgagattggtgccgttgaagtggtgaaccgtcgcctgacgggcaacaacttccatgtttatctcaaacccgatcggctggtggatccggaagcctttggcgtacatggtattgccgatgaatttttgctcgataagcccacgtttgccgaagtagccgatgagttcatggactatattcgcggcgcggagttggtgatccataacgcagcgttcgatatcggctttatggactacgagttttcgttgcttaagcgcgatattccgaagaccaatactttctgtaaggtcaccgatagccttgcggtggcgaggaaaatgtttcccggtaagcgcaacagcctcgatgcgttatgtgctcgctacgaaatagataacagtaaacgaacgctgcacggggcattactcgatgcccagatccttgcggaagtttatctggcgatgaccggtggtcaaacgtcgatggcttttgcgatggaaggagagacacaacagcaacaaggtgaagcaacaattcagcgcattgtacgtcaggcaagtaagttacgcgttgtttttgcgacagatgaagagattgcagctcatgaagcccgtctcgatctggtgcagaagaaaggcggaagttgcctctggcgagcataattcaacatcagtaaaccggacataacccatgaagaaaaatcgcgcttttttgaagtgggcagggggcaagtatcccctgcttgatgatattaaacggcatttgcccaagggcgaatgtctggttgagccttttgtaggtgccgggtcggtgtttctcaacaccgacttttctcgttacatccttgccgatatcaatagcgacctgatcagtctctataacattgtgaagatgcgtactgatgagtacgtacaggccgcacgcgagctgtttgttcccgaaacaaattgcgccgaggtttactatcagttccgcgaagagttcaacaaaagccaggatccgttccgtcgggcggtactgttcttatatttgaaccgctacggttacaacggcctgtgtcgttacaatctgcgcggtgagtttaacgtgccgttcggccgctacaaaaaaccctatttcccggaagcagagttgtatcacttcgctgaaaaagcgcagaacgcctttttctattgtgagtcttacgccgacagcatggcgcgcgcagatgatgcatccgtcgtctattgcgatccgccttatgcaccgctgtctgcgaccgccaactttacggcgtatcacacaaacagttttacgcttgaacaacaagcgcatctggcggagatcgccgaaggtctggttgagcgccatattccagtgctgatctccaatcacgatacgatgttaacgcgtgagtggtatcagcgcgcgaagctgcatgtcgtcaaagttcgacgcagcataagcagcaacggcggcacacgtaaaaaggtggacgaactgctggctttgtacaaaccaggagtcgtttcacccgcgaaaaaataattcagctaagacactgcactggattaagatgaaaacgatcgaagttgatgacgaactctacagctatatcgccagccacactaagcatatcggcgagagcgcatccgacattttacggcgtatgttgaaattttccgccgcatcacagcctgctgctccggtgacgaaagaggttcgcgttgcgtcacctgctatcgtcgaagcgaagccggtcaaaacgattaaagacaaggttcgcgcaatgcgtgaacttctgctttcggatgaatacgcagagcaaaagcgagcggtcaatcgctttatgctgctgttgtctacactatattctcttgacgcccaggcgtttgccgaagcaacggaatcgttgcacggtcgtacacgcgtttactttgcggcagatgaacaaacgctgctgaaaaacggtaatcagaccaagccgaaacatgtgccaggcacgccgtattgggtgatcaccaacaccaacaccggccgtaaatgcagcatgatcgaacacatcatgcagtcgatgcaattcccggcggaactgattgagaaggtttgcggaactatctaataatacaaaaactaggaggaacttcaacatgacaaatttatctgacatcattgaaaaagaaacaggaaaacaactagtgattcaagaatcaattctaatgttaccagaagaagtagaggaagtaatcgggaataaaccagaaagtgatattttagttcatactgcttatgacgaaagtacagatgaaaacgtaatgctattaacttcagatgctccagaatacaaaccttgggcgttagtaattcaagacagtaatggagaaaacaagattaaaatgttgtaagtcgagattaagtaaaccggaatctgaagatgtcttctgaaaccggtccggttgcggttgacccgaccctgcgtcgtcgtatcgaaccgcacgaattcgaagttttcttcgacccgcgtgaactgcgtaaagaaacctgcctgctgtacgaaatcaactggggtggtcgtcactctatctggcgtcacacctctcagaacaccaacaaacacgttgaagttaacttcatcgaaaaattcaccaccgaacgttacttctgcccgaacacccgttgctctatcacctggttcctgtcttggtctccgtgcggtgaatgctctcgtgcgatcaccgaattcctgtctcgttacccgcacgttaccctgttcatctacatcgcgcgtctgtaccaccacgcggacccgcgtaaccgtcagggtctgcgtgacctgatctcttctggtgtgaccatccagatcatgaccgaacaggaatctggttactgctggcgtaacttcgttaactactctccgtctaacgaagcgcactggccgcgttacccgcacctgtgggttcgtctgtacgttctggaactgtactgcatcatcctgggtctgccgccgtgcctgaacatcctgcgtcgtaaacagccgcagctgaccttcttcaccatcgcgctgcagtcttgccactaccagcgtctgccgccgcacatcctgtgggcgaccggtctgaaataaacttaattaacggcactcctcagccaagtcaaaagcctccgaccggaggcttttgactacatgcccatggcgtttacgccccgccctgccactcatcgcagtactgttgtaattcattaagcattctgccgacatggaagccatcacaaacggcatgatgaacctgaatcgccagcggcatcagcaccttgtcgccttgcgtataatatttgcccatagtgaaaacgggggcgaagaagttgtccatattggccacgtttaaatcaaaactggtgaaactcacccagggattggctgagacgaaaaacatattctcaataaaccctttagggaaataggccaggttttcaccgtaacacgccacatcttgcgaatatatgtgtagaaactgccggaaatcgtcgtggtattcactccagagcgatgaaaacgtttcagtttgctcatggaaaacggtgtaacaagggtgaacactatcccatatcaccagctcaccgtctttcattgccatacggaactccggatgagcattcatcaggcgggcaagaatgtgaataaaggccggataaaacttgtgcttatttttctttacggtctttaaaaaggccgtaatatccagctgaacggtctggttataggtacattgagtaactgactgaaatgcctcaaaatgttctttacgatgccattgggatatatcaacggtggtatatccagtgatttttttctccattttagcttccttagctcctgaaaatctcgataactcaaaaaatacgcccggtagtgatcttatttcattatggtgaaagttggaacctcttacgtgccaagccaaataggccgt

SEQ ID NO: 102 - DNA, 6122 bp, Artificial Sequence
  Synthetic Polynucleotide
cactcggtcgctacgctccgggcgtgagactgcggcgggcgctgcggacacatacaaagttacccacagattccgtggataagcaggggactaacatgtgaggcaaaacagcagggccgcgccggtggcgtttttccataggctccgccctcctgccagagttcacataaacagacgcttttccggtgcatctgtgggagccgtgaggctcaaccatgaatctgacagtacgggcgaaacccgacaggacttaaagatccccaccgtttccggcgggtcgctccctcttgcgctctcctgttccgaccctgccgtttaccggatacctgttccgcctttctcccttacgggaagtgtggcgctttctcatagctcacacactggtatctcggctcggtgtaggtcgttcgctccaagctgggctgtaagcaagaactccccgttcagcccgactgctgcgccttatccggtaactgttcacttgagtccaacccggaaaagcacggtaaaacgccactggcagcagccattggtaactgggagttcgcagaggatttgtttagctaaacacgcggttgctcttgaagtgtgcgccaaagtccggctacactggaaggacagatttggttgctgtgctctgcgaaagccagttaccacggttaagcagttccccaactgacttaaccttcgatcaaaccacctccccaggtggttttttcgtttacagggcaaaagattacgcgcagaaaaaaaggatctcaagaagatcctttgatcttttctactgaaccgctctagatttcagtgcaatttatctcttcaaatgtagcacctgaagtcagcccaggaggaagaggacatccggtcaaataaaacgaaaggctcagtcgaaagactgggcctttcgttttagacttagggaccctttatgacaacttgacggctacatcattcactttttcttcacaaccggcacggaactcgctcgggctggccccggtgcattttttaaatacccgcgagaaatagagttgatcgtcaaaaccaacattgcgaccgacggtggcgataggcatccgggtggtgctcaaaagcagcttcgcctggctgatacgttggtcctcgcgccagcttaagacgctaatccctaactgctggcggaaaagatgtgacagacgcgacggcgacaagcaaacatgctgtgcgacgctggcgatatcaaaattgctgtctgccaggtgatcgctgatgtactgacaagcctcgcgtacccgattatccatcggtggatggagcgactcgttaatcgcttccatgcgccgcagtaacaattgctcaagcagatttatcgccagcagctccgaatagcgcccttccccttgcccggcgttaatgatttgcccaaacaggtcgctgaaatgcggctggtgcgcttcatccgggcgaaagaaccccgtattggcaaatattgacggccagttaagccattcatgccagtaggcgcgcggacgaaagtaaacccactggtgataccattcgcgagcctccggatgacgaccgtagtgatgaatctctcctggcgggaacagcaaaatatcacccggtcggcaaacaaattctcgtccctgatttttcaccaccccctgaccgcgaatggtgagattgagaatataacctttcattcccagcggtcggtcgataaaaaaatcgagataaccgttggcctcaatcggcgttaaacccgccaccagatgggcattaaacgagtatcccggcagcaggggatcattttgcgcttcagccatacttttcatactcccaccattcagagaagaaaccaattgtccatattgcatcagacattgccgtcactgcgtcttttactggctcttctcgctaacccaaccggtaaccccgcttattaaaagcattctgtaacaaagcgggaccaaagccatgacaaaaacgcgtaacaaaagtgtctataatcacggcagaaaagtccacattgattatttgcacggcgtcacactttgctatgccatagcatttttatccataagattagcggatcctacctgacgctttttatcgcaactctctactgtttctccatacccgtttttttggacgcgtacaactcaagtctgacataaatgaccgctatgagcactgcaattacacgccagatcgttctcgctaccgcaaccaccggtatgaaccagatcggtgcgcactatgaaggccacaagatcattgagattggtgccgttgaagtggtgaaccgtcgcctgacgggcaacaacttccatgtttatctcaaacccgatcggctggtggatccggaagcctttggcgtacatggtattgccgatgaatttttgctcgataagcccacgtttgccgaagtagccgatgagttcatggactatattcgcggcgcggagttggtgatccataacgcagcgttcgatatcggctttatggactacgagttttcgttgcttaagcgcgatattccgaagaccaatactttctgtaaggtcaccgatagccttgcggtggcgaggaaaatgtttcccggtaagcgcaacagcctcgatgcgttatgtgctcgctacgaaatagataacagtaaacgaacgctgcacggggcattactcgatgcccagatccttgcggaagtttatctggcgatgaccggtggtcaaacgtcgatggcttttgcgatggaaggagagacacaacagcaacaaggtgaagcaacaattcagcgcattgtacgtcaggcaagtaagttacgcgttgtttttgcgacagatgaagagattgcagctcatgaagcccgtctcgatctggtgcagaagaaaggcggaagttgcctctggcgagcataattcaacatcagtaaaccggacataacccatgaagaaaaatcgcgcttttttgaagtgggcagggggcaagtatcccctgcttgatgatattaaacggcatttgcccaagggcgaatgtctggttgagccttttgtaggtgccgggtcggtgtttctcaacaccgacttttctcgttacatccttgccgatatcaatagcgacctgatcagtctctataacattgtgaagatgcgtactgatgagtacgtacaggccgcacgcgagctgtttgttcccgaaacaaattgcgccgaggtttactatcagttccgcgaagagttcaacaaaagccaggatccgttccgtcgggcggtactgttcttatatttgaaccgctacggttacaacggcctgtgtcgttacaatctgcgcggtgagtttaacgtgccgttcggccgctacaaaaaaccctatttcccggaagcagagttgtatcacttcgctgaaaaagcgcagaacgcctttttctattgtgagtcttacgccgacagcatggcgcgcgcagatgatgcatccgtcgtctattgcgatccgccttatgcaccgctgtctgcgaccgccaactttacggcgtatcacacaaacagttttacgcttgaacaacaagcgcatctggcggagatcgccgaaggtctggttgagcgccatattccagtgctgatctccaatcacgatacgatgttaacgcgtgagtggtatcagcgcgcgaagctgcatgtcgtcaaagttcgacgcagcataagcagcaacggcggcacacgtaaaaaggtggacgaactgctggctttgtacaaaccaggagtcgtttcacccgcgaaaaaataattcagctaagacactgcactggattaagatgaaaacgatcgaagttgatgacgaactctacagctatatcgccagccacactaagcatatcggcgagagcgcatccgacattttacggcgtatgttgaaattttccgccgcatcacagcctgctgctccggtgacgaaagaggttcgcgttgcgtcacctgctatcgtcgaagcgaagccggtcaaaacgattaaagacaaggttcgcgcaatgcgtgaacttctgctttcggatgaatacgcagagcaaaagcgagcggtcaatcgctttatgctgctgttgtctacactatattctcttgacgcccaggcgtttgccgaagcaacggaatcgttgcacggtcgtacacgcgtttactttgcggcagatgaacaaacgctgctgaaaaacggtaatcagaccaagccgaaacatgtgccaggcacgccgtattgggtgatcaccaacaccaacaccggccgtaaatgcagcatgatcgaacacatcatgcagtcgatgcaattcccggcggaactgatcgagaaggtttgcggaactatctaataatacaaaaactaggaggaacttcaacatgacaaatttatctgacatcattgaaaaagaaacaggaaaacaactagtgattcaagaatcaattctaatgttaccagaagaagtagaggaagtaatcgggaataaaccagaaagtgatattttagttcatactgcttatgacgaaagtacagatgaaaacgtaatgctattaacttcagatgctccagaatacaaaccttgggcgttagtaattcaagacagtaatggagaaaacaagattaaaatgttgtaagtcgagattaagtaaaccggaatctgaagatgaccgacgcggaatacgttcgtatccacgaaaaactggacatctacaccttcaaaaaacagttcttcaacaacaaaaaatctgtttctcaccgttgctacgttctgttcgaactgaaacgtcgtggtgaacgtcgtgcgtgcttctggggttacgcggttaacaaaccgcagtctggtaccgaacgtggtatccacgcggaaatcttctctatccgtaaagttgaagaatacctgcgtgacaacccgggtcagttcaccatcaactggtactcttcttggtctccgtgcgcggactgcgcggaaaaaatcctggaatggtacaaccaggaactgcgtggtaacggtcacaccctgaaaatctgggcgtgcaaactgtactacgaaaaaaacgcgcgtaaccagatcggtctgtggaacctgcgtgacaacggtgttggtctgaacgtgatggttagcgaacactaccagtgctgccgtaaaatcttcatccagtcttctcacaaccagctgaacgaaaaccgttggctggaaaaaaccctgaaacgtgcggaaaaacgtcgttctgaactgtctatcatgatccaggttaaaatcctgcacaccaccaaatctccggcggtttaaacttaattaacggcactcctcagccaagtcaaaagcctccgaccggaggcttttgactacatgcccatggcgtttacgccccgccctgccactcatcgcagtactgttgtaattcattaagcattctgccgacatggaagccatcacaaacggcatgatgaacctgaatcgccagcggcatcagcaccttgtcgccttgcgtataatatttgcccatagtgaaaacgggggcgaagaagttgtccatattggccacgtttaaatcaaaactggtgaaactcacccagggattggctgagacgaaaaacatattctcaataaaccctttagggaaataggccaggttttcaccgtaacacgccacatcttgcgaatatatgtgtagaaactgccggaaatcgtcgtggtattcactccagagcgatgaaaacgtttcagtttgctcatggaaaacggtgtaacaagggtgaacactatcccatatcaccagctcaccgtctttcattgccatacggaactccggatgagcattcatcaggcgggcaagaatgtgaataaaggccggataaaacttgtgcttatttttctttacggtctttaaaaaggccgtaatatccagctgaacggtctggttataggtacattgagtaactgactgaaatgcctcaaaatgttctttacgatgccattgggatatatcaacggtggtatatccagtgatttttttctccattttagcttccttagctcctgaaaatctcgataactcaaaaaatacgcccggtagtgatcttatttcattatggtgaaagttggaacctcttacgtgccaagccaaataggccgt

SEQ ID NO: 103 - DNA, 6651 bp, Artificial Sequence
  Synthetic Polynucleotide
cactcggtcgctacgctccgggcgtgagactgcggcgggcgctgcggacacatacaaagttacccacagattccgtggataagcaggggactaacatgtgaggcaaaacagcagggccgcgccggtggcgtttttccataggctccgccctcctgccagagttcacataaacagacgcttttccggtgcatctgtgggagccgtgaggctcaaccatgaatctgacagtacgggcgaaacccgacaggacttaaagatccccaccgtttccggcgggtcgctccctcttgcgctctcctgttccgaccctgccgtttaccggatacctgttccgcctttctcccttacgggaagtgtggcgctttctcatagctcacacactggtatctcggctcggtgtaggtcgttcgctccaagctgggctgtaagcaagaactccccgttcagcccgactgctgcgccttatccggtaactgttcacttgagtccaacccggaaaagcacggtaaaacgccactggcagcagccattggtaactgggagttcgcagaggatttgtttagctaaacacgcggttgctcttgaagtgtgcgccaaagtccggctacactggaaggacagatttggttgctgtgctctgcgaaagccagttaccacggttaagcagttccccaactgacttaaccttcgatcaaaccacctccccaggtggttttttcgtttacagggcaaaagattacgcgcagaaaaaaaggatctcaagaagatcctttgatcttttctactgaaccgctctagatttcagtgcaatttatctcttcaaatgtagcacctgaagtcagcccaggaggaagaggacatccggtcaaataaaacgaaaggctcagtcgaaagactgggcctttcgttttagacttagggaccctttatgacaacttgacggctacatcattcactttttcttcacaaccggcacggaactcgctcgggctggccccggtgcattttttaaatacccgcgagaaatagagttgatcgtcaaaaccaacattgcgaccgacggtggcgataggcatccgggtggtgctcaaaagcagcttcgcctggctgatacgttggtcctcgcgccagcttaagacgctaatccctaactgctggcggaaaagatgtgacagacgcgacggcgacaagcaaacatgctgtgcgacgctggcgatatcaaaattgctgtctgccaggtgatcgctgatgtactgacaagcctcgcgtacccgattatccatcggtggatggagcgactcgttaatcgcttccatgcgccgcagtaacaattgctcaagcagatttatcgccagcagctccgaatagcgcccttccccttgcccggcgttaatgatttgcccaaacaggtcgctgaaatgcggctggtgcgcttcatccgggcgaaagaaccccgtattggcaaatattgacggccagttaagccattcatgccagtaggcgcgcggacgaaagtaaacccactggtgataccattcgcgagcctccggatgacgaccgtagtgatgaatctctcctggcgggaacagcaaaatatcacccggtcggcaaacaaattctcgtccctgatttttcaccaccccctgaccgcgaatggtgagattgagaatataacctttcattcccagcggtcggtcgataaaaaaatcgagataaccgttggcctcaatcggcgttaaacccgccaccagatgggcattaaacgagtatcccggcagcaggggatcattttgcgcttcagccatacttttcatactcccaccattcagagaagaaaccaattgtccatattgcatcagacattgccgtcactgcgtcttttactggctcttctcgctaacccaaccggtaaccccgcttattaaaagcattctgtaacaaagcgggaccaaagccatgacaaaaacgcgtaacaaaagtgtctataatcacggcagaaaagtccacattgattatttgcacggcgtcacactttgctatgccatagcatttttatccataagattagcggatcctacctgacgctttttatcgcaactctctactgtttctccatacccgtttttttggacgcgtacaactcaagtctgacataaatgaccgctatgagcactgcaattacacgccagatcgttctcgctaccgcaaccaccggtatgaaccagatcggtgcgcactatgaaggccacaagatcattgagattggtgccgttgaagtggtgaaccgtcgcctgacgggcaacaacttccatgtttatctcaaacccgatcggctggtggatccggaagcctttggcgtacatggtattgccgatgaatttttgctcgataagcccacgtttgccgaagtagccgatgagttcatggactatattcgcggcgcggagttggtgatccataacgcagcgttcgatatcggctttatggactacgagttttcgttgcttaagcgcgatattccgaagaccaatactttctgtaaggtcaccgatagccttgcggtggcgaggaaaatgtttcccggtaagcgcaacagcctcgatgcgttatgtgctcgctacgaaatagataacagtaaacgaacgctgcacggggcattactcgatgcccagatccttgcggaagtttatctggcgatgaccggtggtcaaacgtcgatggcttttgcgatggaaggagagacacaacagcaacaaggtgaagcaacaattcagcgcattgtacgtcaggcaagtaagttacgcgttgtttttgcgacagatgaagagattgcagctcatgaagcccgtctcgatctggtgcagaagaaaggcggaagttgcctctggcgagcataattcaacatcagtaaaccggacataacccatgaagaaaaatcgcgcttttttgaagtgggcagggggcaagtatcccctgcttgatgatattaaacggcatttgcccaagggcgaatgtctggttgagccttttgtaggtgccgggtcggtgtttctcaacaccgacttttctcgttacatccttgccgatatcaatagcgacctgatcagtctctataacattgtgaagatgcgtactgatgagtacgtacaggccgcacgcgagctgtttgttcccgaaacaaattgcgccgaggtttactatcagttccgcgaagagttcaacaaaagccaggatccgttccgtcgggcggtactgttcttatatttgaaccgctacggttacaacggcctgtgtcgttacaatctgcgcggtgagtttaacgtgccgttcggccgctacaaaaaaccctatttcccggaagcagagttgtatcacttcgctgaaaaagcgcagaacgcctttttctattgtgagtcttacgccgacagcatggcgcgcgcagatgatgcatccgtcgtctattgcgatccgccttatgcaccgctgtctgcgaccgccaactttacggcgtatcacacaaacagttttacgcttgaacaacaagcgcatctggcggagatcgccgaaggtctggttgagcgccatattccagtgctgatctccaatcacgatacgatgttaacgcgtgagtggtatcagcgcgcgaagctgcatgtcgtcaaagttcgacgcagcataagcagcaacggcggcacacgtaaaaaggtggacgaactgctggctttgtacaaaccaggagtcgtttcacccgcgaaaaaataattcagctaagacactgcactggattaagatgaaaacgatcgaagttgatgacgaactctacagctatatcgccagccacactaagcatatcggcgagagcgcatccgacattttacggcgtatgttgaaattttccgccgcatcacagcctgctgctccggtgacgaaagaggttcgcgttgcgtcacctgctatcgtcgaagcgaagccggtcaaaacgattaaagacaaggttcgcgcaatgcgtgaacttctgctttcggatgaatacgcagagcaaaagcgagcggtcaatcgctttatgctgctgttgtctacactatattctcttgacgcccaggcgtttgccgaagcaacggaatcgttgcacggtcgtacacgcgtttactttgcggcagatgaacaaacgctgctgaaaaacggtaatcagaccaagccgaaacatgtgccaggcacgccgtattgggtgatcaccaacaccaacaccggccgtaaatgcagcatgatcgaacacatcatgcagtcgatgcaattcccggcggaactgattgagaaggtttgcggaactatctaacggctgaaattaatgaggtcatacccaaatggatagctcgtttacgcccattgaacaaatgctcaaatttcgcgccagccgccacgaagattttccttatcaggagatccttctgactcgtctttgcatgcacatgcaaagcaagctgctggagaaccgcaataaaatgctgaaggctcagggaattaacgagacgttgtttatggcgttgattacgctggagtctcaggaaaaccacagtattcagccttctgaattaagttgtgctcttggctcatcccgtaccaacgcgacgcgtattgccgatgaactggaaaaacgcggttggatcgaacgtcgtgaaagcgataacgatcgccgctgcctgcatctgcaattaacggaaaaaggtcacgagttcttgcgcgaggttttaccaccgcagcataactgcctgcatcaactctggtccgcgctcagcacaacagaaaaagatcagctcgagcaaatcacccgcaaattgctctcccgtctcgaccagatggaacaagacggtgtggttctcgaagcgatgagctaataatacaaaaactaggaggaacttcaacatgacaaatttatctgacatcattgaaaaagaaacaggaaaacaactagtgattcaagaatcaattctaatgttaccagaagaagtagaggaagtaatcgggaataaaccagaaagtgatattttagttcatactgcttatgacgaaagtacagatgaaaacgtaatgctattaacttcagatgctccagaatacaaaccttgggcgttagtaattcaagacagtaatggagaaaacaagattaaaatgttgtaagtcgagattaagtaaaccggaatctgaagatggactctctgctgatgaaccgtcgcaaattcctgtaccagttcaaaaacgttcgttgggcgaaaggtcgtcgtgaaacctacctgtgctacgttgttaaacgtcgtgactctgcgacctctttctctctggacttcggttacctgcgtaacaaaaacggttgccacgttgaactgctgttcctgcgttacatctctgactgggacctggacccgggtcgttgctaccgtgttacctggttcacctcttggtctccgtgctacgactgcgcgcgtcacgttgcggacttcctgcgtggtaacccgaacctgtctctgcgtatcttcaccgcgcgtctgtacttctgcgaagaccgtaaagcggaaccggaaggtctgcgtcgtctgcaccgtgcgggtgttcagatcgcgatcatgaccttcaaagactacttctactgctggaacaccttcgttgaaaaccacgaacgtaccttcaaagcgtgggaaggtctgcacgaaaactctgttcgtctgtctcgtcagctgcgtcgtatcctgctgccgctgtacgaagttgacgacctgcgtgacgcgttccgtaccctgggtctgtaaacttaattaacggcactcctcagccaagtcaaaagcctccgaccggaggcttttgactacatgcccatggcgtttacgccccgccctgccactcatcgcagtactgttgtaattcattaagcattctgccgacatggaagccatcacaaacggcatgatgaacctgaatcgccagcggcatcagcaccttgtcgccttgcgtataatatttgcccatagtgaaaacgggggcgaagaagttgtccatattggccacgtttaaatcaaaactggtgaaactcacccagggattggctgagacgaaaaacatattctcaataaaccctttagggaaataggccaggttttcaccgtaacacgccacatcttgcgaatatatgtgtagaaactgccggaaatcgtcgtggtattcactccagagcgatgaaaacgtttcagtttgctcatggaaaacggtgtaacaagggtgaacactatcccatatcaccagctcaccgtctttcattgccatacggaactccggatgagcattcatcaggcgggcaagaatgtgaataaaggccggataaaacttgtgcttatttttctttacggtctttaaaaaggccgtaatatccagctgaacggtctggttataggtacattgagtaactgactgaaatgcctcaaaatgttctttacgatgccattgggatatatcaacggtggtatatccagtgatttttttctccattttagcttccttagctcctgaaaatctcgataactcaaaaaatacgcccggtagtgatcttatttcattatggtgaaagttggaacctcttacgtgccaagccaaataggccgt

SEQ ID NO: 104 - DNA, 6744 bp, Artificial Sequence
  Synthetic Polynucleotide
cactcggtcgctacgctccgggcgtgagactgcggcgggcgctgcggacacatacaaagttacccacagattccgtggataagcaggggactaacatgtgaggcaaaacagcagggccgcgccggtggcgtttttccataggctccgccctcctgccagagttcacataaacagacgcttttccggtgcatctgtgggagccgtgaggctcaaccatgaatctgacagtacgggcgaaacccgacaggacttaaagatccccaccgtttccggcgggtcgctccctcttgcgctctcctgttccgaccctgccgtttaccggatacctgttccgcctttctcccttacgggaagtgtggcgctttctcatagctcacacactggtatctcggctcggtgtaggtcgttcgctccaagctgggctgtaagcaagaactccccgttcagcccgactgctgcgccttatccggtaactgttcacttgagtccaacccggaaaagcacggtaaaacgccactggcagcagccattggtaactgggagttcgcagaggatttgtttagctaaacacgcggttgctcttgaagtgtgcgccaaagtccggctacactggaaggacagatttggttgctgtgctctgcgaaagccagttaccacggttaagcagttccccaactgacttaaccttcgatcaaaccacctccccaggtggttttttcgtttacagggcaaaagattacgcgcagaaaaaaaggatctcaagaagatcctttgatcttttctactgaaccgctctagatttcagtgcaatttatctcttcaaatgtagcacctgaagtcagcccaggaggaagaggacatccggtcaaataaaacgaaaggctcagtcgaaagactgggcctttcgttttagacttagggaccctttatgacaacttgacggctacatcattcactttttcttcacaaccggcacggaactcgctcgggctggccccggtgcattttttaaatacccgcgagaaatagagttgatcgtcaaaaccaacattgcgaccgacggtggcgataggcatccgggtggtgctcaaaagcagcttcgcctggctgatacgttggtcctcgcgccagcttaagacgctaatccctaactgctggcggaaaagatgtgacagacgcgacggcgacaagcaaacatgctgtgcgacgctggcgatatcaaaattgctgtctgccaggtgatcgctgatgtactgacaagcctcgcgtacccgattatccatcggtggatggagcgactcgttaatcgcttccatgcgccgcagtaacaattgctcaagcagatttatcgccagcagctccgaatagcgcccttccccttgcccggcgttaatgatttgcccaaacaggtcgctgaaatgcggctggtgcgcttcatccgggcgaaagaaccccgtattggcaaatattgacggccagttaagccattcatgccagtaggcgcgcggacgaaagtaaacccactggtgataccattcgcgagcctccggatgacgaccgtagtgatgaatctctcctggcgggaacagcaaaatatcacccggtcggcaaacaaattctcgtccctgatttttcaccaccccctgaccgcgaatggtgagattgagaatataacctttcattcccagcggtcggtcgataaaaaaatcgagataaccgttggcctcaatcggcgttaaacccgccaccagatgggcattaaacgagtatcccggcagcaggggatcattttgcgcttcagccatacttttcatactcccaccattcagagaagaaaccaattgtccatattgcatcagacattgccgtcactgcgtcttttactggctcttctcgctaacccaaccggtaaccccgcttattaaaagcattctgtaacaaagcgggaccaaagccatgacaaaaacgcgtaacaaaagtgtctataatcacggcagaaaagtccacattgattatttgcacggcgtcacactttgctatgccatagcatttttatccataagattagcggatcctacctgacgctttttatcgcaactctctactgtttctccatacccgtttttttggacgcgtacaactcaagtctgacataaatgaccgctatgagcactgcaattacacgccagatcgttctcgctaccgcaaccaccggtatgaaccagatcggtgcgcactatgaaggccacaagatcattgagattggtgccgttgaagtggtgaaccgtcgcctgacgggcaacaacttccatgtttatctcaaacccgatcggctggtggatccggaagcctttggcgtacatggtattgccgatgaatttttgctcgataagcccacgtttgccgaagtagccgatgagttcatggactatattcgcggcgcggagttggtgatccataacgcagcgttcgatatcggctttatggactacgagttttcgttgcttaagcgcgatattccgaagaccaatactttctgtaaggtcaccgatagccttgcggtggcgaggaaaatgtttcccggtaagcgcaacagcctcgatgcgttatgtgctcgctacgaaatagataacagtaaacgaacgctgcacggggcattactcgatgcccagatccttgcggaagtttatctggcgatgaccggtggtcaaacgtcgatggcttttgcgatggaaggagagacacaacagcaacaaggtgaagcaacaattcagcgcattgtacgtcaggcaagtaagttacgcgttgtttttgcgacagatgaagagattgcagctcatgaagcccgtctcgatctggtgcagaagaaaggcggaagttgcctctggcgagcataattcaacatcagtaaaccggacataacccatgaagaaaaatcgcgcttttttgaagtgggcagggggcaagtatcccctgcttgatgatattaaacggcatttgcccaagggcgaatgtctggttgagccttttgtaggtgccgggtcggtgtttctcaacaccgacttttctcgttacatccttgccgatatcaatagcgacctgatcagtctctataacattgtgaagatgcgtactgatgagtacgtacaggccgcacgcgagctgtttgttcccgaaacaaattgcgccgaggtttactatcagttccgcgaagagttcaacaaaagccaggatccgttccgtcgggcggtactgttcttatatttgaaccgctacggttacaacggcctgtgtcgttacaatctgcgcggtgagtttaacgtgccgttcggccgctacaaaaaaccctatttcccggaagcagagttgtatcacttcgctgaaaaagcgcagaacgcctttttctattgtgagtcttacgccgacagcatggcgcgcgcagatgatgcatccgtcgtctattgcgatccgccttatgcaccgctgtctgcgaccgccaactttacggcgtatcacacaaacagttttacgcttgaacaacaagcgcatctggcggagatcgccgaaggtctggttgagcgccatattccagtgctgatctccaatcacgatacgatgttaacgcgtgagtggtatcagcgcgcgaagctgcatgtcgtcaaagttcgacgcagcataagcagcaacggcggcacacgtaaaaaggtggacgaactgctggctttgtacaaaccaggagtcgtttcacccgcgaaaaaataattcagctaagacactgcactggattaagatgaaaacgatcgaagttgatgacgaactctacagctatatcgccagccacactaagcatatcggcgagagcgcatccgacattttacggcgtatgttgaaattttccgccgcatcacagcctgctgctccggtgacgaaagaggttcgcgttgcgtcacctgctatcgtcgaagcgaagccggtcaaaacgattaaagacaaggttcgcgcaatgcgtgaacttctgctttcggatgaatacgcagagcaaaagcgagcggtcaatcgctttatgctgctgttgtctacactatattctcttgacgcccaggcgtttgccgaagcaacggaatcgttgcacggtcgtacacgcgtttactttgcggcagatgaacaaacgctgctgaaaaacggtaatcagaccaagccgaaacatgtgccaggcacgccgtattgggtgatcaccaacaccaacaccggccgtaaatgcagcatgatcgaacacatcatgcagtcgatgcaattcccggcggaactgattgagaaggtttgcggaactatctaacggctgaaattaatgaggtcatacccaaatggatagctcgtttacgcccattgaacaaatgctcaaatttcgcgccagccgccacgaagattttccttatcaggagatccttctgactcgtctttgcatgcacatgcaaagcaagctgctggagaaccgcaataaaatgctgaaggctcagggaattaacgagacgttgtttatggcgttgattacgctggagtctcaggaaaaccacagtattcagccttctgaattaagttgtgctcttggctcatcccgtaccaacgcgacgcgtattgccgatgaactggaaaaacgcggttggatcgaacgtcgtgaaagcgataacgatcgccgctgcctgcatctgcaattaacggaaaaaggtcacgagttcttgcgcgaggttttaccaccgcagcataactgcctgcatcaactctggtccgcgctcagcacaacagaaaaagatcagctcgagcaaatcacccgcaaattgctctcccgtctcgaccagatggaacaagacggtgtggttctcgaagcgatgagctaataatacaaaaactaggaggaacttcaacatgacaaatttatctgacatcattgaaaaagaaacaggaaaacaactagtgattcaagaatcaattctaatgttaccagaagaagtagaggaagtaatcgggaataaaccagaaagtgatattttagttcatactgcttatgacgaaagtacagatgaaaacgtaatgctattaacttcagatgctccagaatacaaaccttgggcgttagtaattcaagacagtaatggagaaaacaagattaaaatgttgtaagtcgagattaagtaaaccggaatctgaagatgtcttctgaaaccggtccggttgcggttgacccgaccctgcgtcgtcgtatcgaaccgcacgaattcgaagttttcttcgacccgcgtgaactgcgtaaagaaacctgcctgctgtacgaaatcaactggggtggtcgtcactctatctggcgtcacacctctcagaacaccaacaaacacgttgaagttaacttcatcgaaaaattcaccaccgaacgttacttctgcccgaacacccgttgctctatcacctggttcctgtcttggtctccgtgcggtgaatgctctcgtgcgatcaccgaattcctgtctcgttacccgcacgttaccctgttcatctacatcgcgcgtctgtaccaccacgcggacccgcgtaaccgtcagggtctgcgtgacctgatctcttctggtgtgaccatccagatcatgaccgaacaggaatctggttactgctggcgtaacttcgttaactactctccgtctaacgaagcgcactggccgcgttacccgcacctgtgggttcgtctgtacgttctggaactgtactgcatcatcctgggtctgccgccgtgcctgaacatcctgcgtcgtaaacagccgcagctgaccttcttcaccatcgcgctgcagtcttgccactaccagcgtctgccgccgcacatcctgtgggcgaccggtctgaaataaacttaattaacggcactcctcagccaagtcaaaagcctccgaccggaggcttttgactacatgcccatggcgtttacgccccgccctgccactcatcgcagtactgttgtaattcattaagcattctgccgacatggaagccatcacaaacggcatgatgaacctgaatcgccagcggcatcagcaccttgtcgccttgcgtataatatttgcccatagtgaaaacgggggcgaagaagttgtccatattggccacgtttaaatcaaaactggtgaaactcacccagggattggctgagacgaaaaacatattctcaataaaccctttagggaaataggccaggttttcaccgtaacacgccacatcttgcgaatatatgtgtagaaactgccggaaatcgtcgtggtattcactccagagcgatgaaaacgtttcagtttgctcatggaaaacggtgtaacaagggtgaacactatcccatatcaccagctcaccgtctttcattgccatacggaactccggatgagcattcatcaggcgggcaagaatgtgaataaaggccggataaaacttgtgcttatttttctttacggtctttaaaaaggccgtaatatccagctgaacggtctggttataggtacattgagtaactgactgaaatgcctcaaaatgttctttacgatgccattgggatatatcaacggtggtatatccagtgatttttttctccattttagcttccttagctcctgaaaatctcgataactcaaaaaatacgcccggtagtgatcttatttcattatggtgaaagttggaacctcttacgtgccaagccaaataggccgt

SEQ ID NO: 105 - DNA, 6681 bp, Artificial Sequence
  Synthetic Polynucleotide
cactcggtcgctacgctccgggcgtgagactgcggcgggcgctgcggacacatacaaagttacccacagattccgtggataagcaggggactaacatgtgaggcaaaacagcagggccgcgccggtggcgtttttccataggctccgccctcctgccagagttcacataaacagacgcttttccggtgcatctgtgggagccgtgaggctcaaccatgaatctgacagtacgggcgaaacccgacaggacttaaagatccccaccgtttccggcgggtcgctccctcttgcgctctcctgttccgaccctgccgtttaccggatacctgttccgcctttctcccttacgggaagtgtggcgctttctcatagctcacacactggtatctcggctcggtgtaggtcgttcgctccaagctgggctgtaagcaagaactccccgttcagcccgactgctgcgccttatccggtaactgttcacttgagtccaacccggaaaagcacggtaaaacgccactggcagcagccattggtaactgggagttcgcagaggatttgtttagctaaacacgcggttgctcttgaagtgtgcgccaaagtccggctacactggaaggacagatttggttgctgtgctctgcgaaagccagttaccacggttaagcagttccccaactgacttaaccttcgatcaaaccacctccccaggtggttttttcgtttacagggcaaaagattacgcgcagaaaaaaaggatctcaagaagatcctttgatcttttctactgaaccgctctagatttcagtgcaatttatctcttcaaatgtagcacctgaagtcagcccaggaggaagaggacatccggtcaaataaaacgaaaggctcagtcgaaagactgggcctttcgttttagacttagggaccctttatgacaacttgacggctacatcattcactttttcttcacaaccggcacggaactcgctcgggctggccccggtgcattttttaaatacccgcgagaaatagagttgatcgtcaaaaccaacattgcgaccgacggtggcgataggcatccgggtggtgctcaaaagcagcttcgcctggctgatacgttggtcctcgcgccagcttaagacgctaatccctaactgctggcggaaaagatgtgacagacgcgacggcgacaagcaaacatgctgtgcgacgctggcgatatcaaaattgctgtctgccaggtgatcgctgatgtactgacaagcctcgcgtacccgattatccatcggtggatggagcgactcgttaatcgcttccatgcgccgcagtaacaattgctcaagcagatttatcgccagcagctccgaatagcgcccttccccttgcccggcgttaatgatttgcccaaacaggtcgctgaaatgcggctggtgcgcttcatccgggcgaaagaaccccgtattggcaaatattgacggccagttaagccattcatgccagtaggcgcgcggacgaaagtaaacccactggtgataccattcgcgagcctccggatgacgaccgtagtgatgaatctctcctggcgggaacagcaaaatatcacccggtcggcaaacaaattctcgtccctgatttttcaccaccccctgaccgcgaatggtgagattgagaatataacctttcattcccagcggtcggtcgataaaaaaatcgagataaccgttggcctcaatcggcgttaaacccgccaccagatgggcattaaacgagtatcccggcagcaggggatcattttgcgcttcagccatacttttcatactcccaccattcagagaagaaaccaattgtccatattgcatcagacattgccgtcactgcgtcttttactggctcttctcgctaacccaaccggtaaccccgcttattaaaagcattctgtaacaaagcgggaccaaagccatgacaaaaacgcgtaacaaaagtgtctataatcacggcagaaaagtccacattgattatttgcacggcgtcacactttgctatgccatagcatttttatccataagattagcggatcctacctgacgctttttatcgcaactctctactgtttctccatacccgtttttttggacgcgtacaactcaagtctgacataaatgaccgctatgagcactgcaattacacgccagatcgttctcgctaccgcaaccaccggtatgaaccagatcggtgcgcactatgaaggccacaagatcattgagattggtgccgttgaagtggtgaaccgtcgcctgacgggcaacaacttccatgtttatctcaaacccgatcggctggtggatccggaagcctttggcgtacatggtattgccgatgaatttttgctcgataagcccacgtttgccgaagtagccgatgagttcatggactatattcgcggcgcggagttggtgatccataacgcagcgttcgatatcggctttatggactacgagttttcgttgcttaagcgcgatattccgaagaccaatactttctgtaaggtcaccgatagccttgcggtggcgaggaaaatgtttcccggtaagcgcaacagcctcgatgcgttatgtgctcgctacgaaatagataacagtaaacgaacgctgcacggggcattactcgatgcccagatccttgcggaagtttatctggcgatgaccggtggtcaaacgtcgatggcttttgcgatggaaggagagacacaacagcaacaaggtgaagcaacaattcagcgcattgtacgtcaggcaagtaagttacgcgttgtttttgcgacagatgaagagattgcagctcatgaagcccgtctcgatctggtgcagaagaaaggcggaagttgcctctggcgagcataattcaacatcagtaaaccggacataacccatgaagaaaaatcgcgcttttttgaagtgggcagggggcaagtatcccctgcttgatgatattaaacggcatttgcccaagggcgaatgtctggttgagccttttgtaggtgccgggtcggtgtttctcaacaccgacttttctcgttacatccttgccgatatcaatagcgacctgatcagtctctataacattgtgaagatgcgtactgatgagtacgtacaggccgcacgcgagctgtttgttcccgaaacaaattgcgccgaggtttactatcagttccgcgaagagttcaacaaaagccaggatccgttccgtcgggcggtactgttcttatatttgaaccgctacggttacaacggcctgtgtcgttacaatctgcgcggtgagtttaacgtgccgttcggccgctacaaaaaaccctatttcccggaagcagagttgtatcacttcgctgaaaaagcgcagaacgcctttttctattgtgagtcttacgccgacagcatggcgcgcgcagatgatgcatccgtcgtctattgcgatccgccttatgcaccgctgtctgcgaccgccaactttacggcgtatcacacaaacagttttacgcttgaacaacaagcgcatctggcggagatcgccgaaggtctggttgagcgccatattccagtgctgatctccaatcacgatacgatgttaacgcgtgagtggtatcagcgcgcgaagctgcatgtcgtcaaagttcgacgcagcataagcagcaacggcggcacacgtaaaaaggtggacgaactgctggctttgtacaaaccaggagtcgtttcacccgcgaaaaaataattcagctaagacactgcactggattaagatgaaaacgatcgaagttgatgacgaactctacagctatatcgccagccacactaagcatatcggcgagagcgcatccgacattttacggcgtatgttgaaattttccgccgcatcacagcctgctgctccggtgacgaaagaggttcgcgttgcgtcacctgctatcgtcgaagcgaagccggtcaaaacgattaaagacaaggttcgcgcaatgcgtgaacttctgctttcggatgaatacgcagagcaaaagcgagcggtcaatcgctttatgctgctgttgtctacactatattctcttgacgcccaggcgtttgccgaagcaacggaatcgttgcacggtcgtacacgcgtttactttgcggcagatgaacaaacgctgctgaaaaacggtaatcagaccaagccgaaacatgtgccaggcacgccgtattgggtgatcaccaacaccaacaccggccgtaaatgcagcatgatcgaacacatcatgcagtcgatgcaattcccggcggaactgattgagaaggtttgcggaactatctaacggctgaaattaatgaggtcatacccaaatggatagctcgtttacgcccattgaacaaatgctcaaatttcgcgccagccgccacgaagattttccttatcaggagatccttctgactcgtctttgcatgcacatgcaaagcaagctgctggagaaccgcaataaaatgctgaaggctcagggaattaacgagacgttgtttatggcgttgattacgctggagtctcaggaaaaccacagtattcagccttctgaattaagttgtgctcttggctcatcccgtaccaacgcgacgcgtattgccgatgaactggaaaaacgcggttggatcgaacgtcgtgaaagcgataacgatcgccgctgcctgcatctgcaattaacggaaaaaggtcacgagttcttgcgcgaggttttaccaccgcagcataactgcctgcatcaactctggtccgcgctcagcacaacagaaaaagatcagctcgagcaaatcacccgcaaattgctctcccgtctcgaccagatggaacaagacggtgtggttctcgaagcgatgagctaataatacaaaaactaggaggaacttcaacatgacaaatttatctgacatcattgaaaaagaaacaggaaaacaactagtgattcaagaatcaattctaatgttaccagaagaagtagaggaagtaatcgggaataaaccagaaagtgatattttagttcatactgcttatgacgaaagtacagatgaaaacgtaatgctattaacttcagatgctccagaatacaaaccttgggcgttagtaattcaagacagtaatggagaaaacaagattaaaatgttgtaagtcgagattaagtaaaccggaatctgaagatgaccgacgcggaatacgttcgtatccacgaaaaactggacatctacaccttcaaaaaacagttcttcaacaacaaaaaatctgtttctcaccgttgctacgttctgttcgaactgaaacgtcgtggtgaacgtcgtgcgtgcttctggggttacgcggttaacaaaccgcagtctggtaccgaacgtggtatccacgcggaaatcttctctatccgtaaagttgaagaatacctgcgtgacaacccgggtcagttcaccatcaactggtactcttcttggtctccgtgcgcggactgcgcggaaaaaatcctggaatggtacaaccaggaactgcgtggtaacggtcacaccctgaaaatctgggcgtgcaaactgtactacgaaaaaaacgcgcgtaaccagatcggtctgtggaacctgcgtgacaacggtgttggtctgaacgtgatggttagcgaacactaccagtgctgccgtaaaatcttcatccagtcttctcacaaccagctgaacgaaaaccgttggctggaaaaaaccctgaaacgtgcggaaaaacgtcgttctgaactgtctatcatgatccaggttaaaatcctgcacaccaccaaatctccggcggtttaaacttaattaacggcactcctcagccaagtcaaaagcctccgaccggaggcttttgactacatgcccatggcgtttacgccccgccctgccactcatcgcagtactgttgtaattcattaagcattctgccgacatggaagccatcacaaacggcatgatgaacctgaatcgccagcggcatcagcaccttgtcgccttgcgtataatatttgcccatagtgaaaacgggggcgaagaagttgtccatattggccacgtttaaatcaaaactggtgaaactcacccagggattggctgagacgaaaaacatattctcaataaaccctttagggaaataggccaggttttcaccgtaacacgccacatcttgcgaatatatgtgtagaaactgccggaaatcgtcgtggtattcactccagagcgatgaaaacgtttcagtttgctcatggaaaacggtgtaacaagggtgaacactatcccatatcaccagctcaccgtctttcattgccatacggaactccggatgagcattcatcaggcgggcaagaatgtgaataaaggccggataaaacttgtgcttatttttctttacggtctttaaaaaggccgtaatatccagctgaacggtctggttataggtacattgagtaactgactgaaatgcctcaaaatgttctttacgatgccattgggatatatcaacggtggtatatccagtgatttttttctccattttagcttccttagctcctgaaaatctcgataactcaaaaaatacgcccggtagtgatcttatttcattatggtgaaagttggaacctcttacgtgccaagccaaataggccgt

SEQ ID NO: 106 - DNA, 4664 bp, Artificial Sequence
  Synthetic Polynucleotide
cactcggtcgctacgctccgggcgtgagactgcggcgggcgctgcggacacatacaaagttacccacagattccgtggataagcaggggactaacatgtgaggcaaaacagcagggccgcgccggtggcgtttttccataggctccgccctcctgccagagttcacataaacagacgcttttccggtgcatctgtgggagccgtgaggctcaaccatgaatctgacagtacgggcgaaacccgacaggacttaaagatccccaccgtttccggcgggtcgctccctcttgcgctctcctgttccgaccctgccgtttaccggatacctgttccgcctttctcccttacgggaagtgtggcgctttctcatagctcacacactggtatctcggctcggtgtaggtcgttcgctccaagctgggctgtaagcaagaactccccgttcagcccgactgctgcgccttatccggtaactgttcacttgagtccaacccggaaaagcacggtaaaacgccactggcagcagccattggtaactgggagttcgcagaggatttgtttagctaaacacgcggttgctcttgaagtgtgcgccaaagtccggctacactggaaggacagatttggttgctgtgctctgcgaaagccagttaccacggttaagcagttccccaactgacttaaccttcgatcaaaccacctccccaggtggttttttcgtttacagggcaaaagattacgcgcagaaaaaaaggatctcaagaagatcctttgatcttttctactgaaccgctctagatttcagtgcaatttatctcttcaaatgtagcacctgaagtcagcccaggaggaagaggacatccggtcaaataaaacgaaaggctcagtcgaaagactgggcctttcgttttagacttagggaccctttatgacaacttgacggctacatcattcactttttcttcacaaccggcacggaactcgctcgggctggccccggtgcattttttaaatacccgcgagaaatagagttgatcgtcaaaaccaacattgcgaccgacggtggcgataggcatccgggtggtgctcaaaagcagcttcgcctggctgatacgttggtcctcgcgccagcttaagacgctaatccctaactgctggcggaaaagatgtgacagacgcgacggcgacaagcaaacatgctgtgcgacgctggcgatatcaaaattgctgtctgccaggtgatcgctgatgtactgacaagcctcgcgtacccgattatccatcggtggatggagcgactcgttaatcgcttccatgcgccgcagtaacaattgctcaagcagatttatcgccagcagctccgaatagcgcccttccccttgcccggcgttaatgatttgcccaaacaggtcgctgaaatgcggctggtgcgcttcatccgggcgaaagaaccccgtattggcaaatattgacggccagttaagccattcatgccagtaggcgcgcggacgaaagtaaacccactggtgataccattcgcgagcctccggatgacgaccgtagtgatgaatctctcctggcgggaacagcaaaatatcacccggtcggcaaacaaattctcgtccctgatttttcaccaccccctgaccgcgaatggtgagattgagaatataacctttcattcccagcggtcggtcgataaaaaaatcgagataaccgttggcctcaatcggcgttaaacccgccaccagatgggcattaaacgagtatcccggcagcaggggatcattttgcgcttcagccatacttttcatactcccaccattcagagaagaaaccaattgtccatattgcatcagacattgccgtcactgcgtcttttactggctcttctcgctaacccaaccggtaaccccgcttattaaaagcattctgtaacaaagcgggaccaaagccatgacaaaaacgcgtaacaaaagtgtctataatcacggcagaaaagtccacattgattatttgcacggcgtcacactttgctatgccatagcatttttatccataagattagcggatcctacctgacgctttttatcgcaactctctactgtttctccatacccgtttttttggacgcgtacaactcaagtctgacataaatgaccgctatgagcactgcaattacacgccagatcgttctcgctaccgcaaccaccggtatgaaccagattggtgcgcactatgaaggccacaagatcattgagattggtgccgttgaagtggtgaaccgtcgcctgacgggcaataacttccatgtttatctcaaacccgatcggctggtggatccggaagcctttggcgtacatggtattgccgatgaatttttgctcgataagcccacgtttgccgaagtagccgatgagttcatggactatattcgcggcgcggagttggtgatccataacgcagcgttcgatatcggctttatggactacgagttttcgttgcttaagcgcgatattccgaagaccaatactttctgtaaggtcaccgatagccttgcggtggcgaggaaaatgtttcccggtaagcgcaacagcctcgatgcgttatgtgctcgctacgaaatagataacagtaaacgaacgctgcacggggcattactcgatgcccagatccttgcggaagtttatctggcgatgaccggtggtcaaacgtcgatggcttttgcgatggaaggagagacacaacagcaacaaggtgaagcaacaattcagcgcattgtacgtcaggcaagtaagttacgcgttgtttttgcgacagatgaagagattgcagctcatgaagcccgtctcgatctggtgcagaagaaaggcggaagttgcctctggcgagcataagtcgagattaagtaaaccggaatctgaagatgaaactgaaacgtgaatacgacgaactgatcaaagcggacgcggttaaagaaatcgcgaaagaactgggttctcgtccgctggaagttgcgctgccggaaaaatacatcgcgcgtcacgaagaaaaattcaacatggcgtgcgaacacatcctggaaaaagacccgtctctgttcccgatcctgaaaaacaacgaattcaccctgtacctgaaagaaacccaggttccgaacaccctggaagactacttcatccgtctggcgtctaccatcctgtctcagcagatctctggtcaggcggcggaatctatcaaagcgcgtgttgtttctctgtacggtggtgcgttcccggactacaaaatcctgttcgaagacttcaaagacccggcgaaatgcgcggaaatcgcgaaatgcggtctgtctaaacgtaaaatgatctacctggaatctctggcggtttacttcaccgaaaaatacaaagacatcgaaaaactgttcggtcagaaagacaacgacgaagaagttatcgaatctctggttaccaacgttaaaggtatcggtccgtggtctgcgaaaatgttcctgatctctggtctgaaacgtatggacgttttcgcgccggaagacctgggtatcgcgcgtggtttctctaaatacctgtctgacaaaccggaactggaaaaagaactgatgcgtgaacgtaaagttgttaaaaaatctaaaatcaaacacaaaaaatacaactggaaaatctacgacgacgacatcatggaaaaatgctctgaaaccttctctccgtaccgttctgttttcatgttcatcctgtggcgtctggcgtctaccaacaccgacgcgatgatgaaagcggaagaaaacttcgttaaatcttaaacttaattaacggcactcctcagccaagtcaaaagcctccgaccggaggcttttgactacatgcccatggcgtttacgccccgccctgccactcatcgcagtactgttgtaattcattaagcattctgccgacatggaagccatcacaaacggcatgatgaacctgaatcgccagcggcatcagcaccttgtcgccttgcgtataatatttgcccatagtgaaaacgggggcgaagaagttgtccatattggccacgtttaaatcaaaactggtgaaactcacccagggattggctgagacgaaaaacatattctcaataaaccctttagggaaataggccaggttttcaccgtaacacgccacatcttgcgaatatatgtgtagaaactgccggaaatcgtcgtggtattcactccagagcgatgaaaacgtttcagtttgctcatggaaaacggtgtaacaagggtgaacactatcccatatcaccagctcaccgtctttcattgccatacggaactccggatgagcattcatcaggcgggcaagaatgtgaataaaggccggataaaacttgtgcttatttttctttacggtctttaaaaaggccgtaatatccagctgaacggtctggttataggtacattgagcaactgactgaaatgcctcaaaatgttctttacgatgccattgggatatatcaacggtggtatatccagtgatttttttctccattttagcttccttagctcctgaaaatctcgataactcaaaaaatacgcccggtagtgatcttatttcattatggtgaaagttggaacctcttacgtgccaagccaaataggccgt

SEQ ID NO: 107 - DNA, 4670 bp, Artificial Sequence
  Synthetic Polynucleotide
cactcggtcgctacgctccgggcgtgagactgcggcgggcgctgcggacacatacaaagttacccacagattccgtggataagcaggggactaacatgtgaggcaaaacagcagggccgcgccggtggcgtttttccataggctccgccctcctgccagagttcacataaacagacgcttttccggtgcatctgtgggagccgtgaggctcaaccatgaatctgacagtacgggcgaaacccgacaggacttaaagatccccaccgtttccggcgggtcgctccctcttgcgctctcctgttccgaccctgccgtttaccggatacctgttccgcctttctcccttacgggaagtgtggcgctttctcatagctcacacactggtatctcggctcggtgtaggtcgttcgctccaagctgggctgtaagcaagaactccccgttcagcccgactgctgcgccttatccggtaactgttcacttgagtccaacccggaaaagcacggtaaaacgccactggcagcagccattggtaactgggagttcgcagaggatttgtttagctaaacacgcggttgctcttgaagtgtgcgccaaagtccggctacactggaaggacagatttggttgctgtgctctgcgaaagccagttaccacggttaagcagttccccaactgacttaaccttcgatcaaaccacctccccaggtggttttttcgtttacagggcaaaagattacgcgcagaaaaaaaggatctcaagaagatcctttgatcttttctactgaaccgctctagatttcagtgcaatttatctcttcaaatgtagcacctgaagtcagcccaggaggaagaggacatccggtcaaataaaacgaaaggctcagtcgaaagactgggcctttcgttttagacttagggaccctttatgacaacttgacggctacatcattcactttttcttcacaaccggcacggaactcgctcgggctggccccggtgcattttttaaatacccgcgagaaatagagttgatcgtcaaaaccaacattgcgaccgacggtggcgataggcatccgggtggtgctcaaaagcagcttcgcctggctgatacgttggtcctcgcgccagcttaagacgctaatccctaactgctggcggaaaagatgtgacagacgcgacggcgacaagcaaacatgctgtgcgacgctggcgatatcaaaattgctgtctgccaggtgatcgctgatgtactgacaagcctcgcgtacccgattatccatcggtggatggagcgactcgttaatcgcttccatgcgccgcagtaacaattgctcaagcagatttatcgccagcagctccgaatagcgcccttccccttgcccggcgttaatgatttgcccaaacaggtcgctgaaatgcggctggtgcgcttcatccgggcgaaagaaccccgtattggcaaatattgacggccagttaagccattcatgccagtaggcgcgcggacgaaagtaaacccactggtgataccattcgcgagcctccggatgacgaccgtagtgatgaatctctcctggcgggaacagcaaaatatcacccggtcggcaaacaaattctcgtccctgatttttcaccaccccctgaccgcgaatggtgagattgagaatataacctttcattcccagcggtcggtcgataaaaaaatcgagataaccgttggcctcaatcggcgttaaacccgccaccagatgggcattaaacgagtatcccggcagcaggggatcattttgcgcttcagccatacttttcatactcccaccattcagagaagaaaccaattgtccatattgcatcagacattgccgtcactgcgtcttttactggctcttctcgctaacccaaccggtaaccccgcttattaaaagcattctgtaacaaagcgggaccaaagccatgacaaaaacgcgtaacaaaagtgtctataatcacggcagaaaagtccacattgattatttgcacggcgtcacactttgctatgccatagcatttttatccataagattagcggatcctacctgacgctttttatcgcaactctctactgtttctccatacccgtttttttggacgcgtacaactcaagtctgacataaatgaccgctatgagcactgcaattacacgccagatcgttctcgctaccgcaaccaccggtatgaaccagattggtgcgcactatgaaggccacaagatcattgagattggtgccgttgaagtggtgaaccgtcgcctgacgggcaataacttccatgtttatctcaaacccgatcggctggtggatccggaagcctttggcgtacatggtattgccgatgaatttttgctcgataagcccacgtttgccgaagtagccgatgagttcatggactatattcgcggcgcggagttggtgatccataacgcagcgttcgatatcggctttatggactacgagttttcgttgcttaagcgcgatattccgaagaccaatactttctgtaaggtcaccgatagccttgcggtggcgaggaaaatgtttcccggtaagcgcaacagcctcgatgcgttatgtgctcgctacgaaatagataacagtaaacgaacgctgcacggggcattactcgatgcccagatccttgcggaagtttatctggcgatgaccggtggtcaaacgtcgatggcttttgcgatggaaggagagacacaacagcaacaaggtgaagcaacaattcagcgcattgtacgtcaggcaagtaagttacgcgttgtttttgcgacagatgaagagattgcagctcatgaagcccgtctcgatctggtgcagaagaaaggcggaagttgcctctggcgagcataagtcgagattaagtaaaccggaatctgaagatggttaccccggcgctgcagatgaaaaaaccgaaacagttctgccgtcgtatgggtcagaaaaaacagcgtccggcgcgtgcgggtcagccgcactcttcttctgacgcggcgcaggcgccggcggaacagccgcactcttcttctgacgcggcgcaggcgccgtgcccgcgtgaacgttgcctgggtccgccgaccaccccgggtccgtaccgttctatctacttctcttctccgaaaggtcacctgacccgtctgggtctggaattcttcgaccagccggcggttccgctggcgcgtgcgttcctgggtcaggttctggttcgtcgtctgccgaacggtaccgaactgcgtggtcgtatcgttgaaaccgaagcgatcctgggtccggaagacgaagcggcgctgtctcgtggtggtcgtcagaccccgcgtaaccgtggtatgttcatgaaaccgggtaccctgtacgtttacatcatctacggtatgtacttctgcatgaacatctcttctcagggtgacggtgcgtgcgttctgctgcgtgcgctggaaccgctggaaggtctggaaaccatgcgtcagctgcgttctaccctgcgtaaaggtaccgcgtctcgtgttctgaaagaccgtgaactgtgctctggtccgtctaaactgtgccaggcgctggcgatcaacaaatctttcgaccagcgtgacctggcgcaggacgaagcggtttggctggaacgtggtccgctggaaccgtctgaaccggcggttgttgcggcggcgcgtgttggtgttggtcacgcgggtgaatgggcgcgtaaaccgctgcgtttctacgttcgtggttctccgtgggtttctgttgttgaccgtgttgcggaacaggacacccaggcgtaaacttaattaacggcactcctcagccaagtcaaaagcctccgaccggaggcttttgactacatgcccatggcgtttacgccccgccctgccactcatcgcagtactgttgtaattcattaagcattctgccgacatggaagccatcacaaacggcatgatgaacctgaatcgccagcggcatcagcaccttgtcgccttgcgtataatatttgcccatagtgaaaacgggggcgaagaagttgtccatattggccacgtttaaatcaaaactggtgaaactcacccagggattggctgagacgaaaaacatattctcaataaaccctttagggaaataggccaggttttcaccgtaacacgccacatcttgcgaatatatgtgtagaaactgccggaaatcgtcgtggtattcactccagagcgatgaaaacgtttcagtttgctcatggaaaacggtgtaacaagggtgaacactatcccatatcaccagctcaccgtctttcattgccatacggaactccggatgagcattcatcaggcgggcaagaatgtgaataaaggccggataaaacttgtgcttatttttctttacggtctttaaaaaggccgtaatatccagctgaacggtctggttataggtacattgagtaactgactgaaatgcctcaaaatgttctttacgatgccattgggatatatcaacggtggtatatccagtgatttttttctccattttagcttccttagctcctgaaaatctcgataactcaaaaaatacgcccggtagtgatcttatttcattatggtgaaagttggaacctcttacgtgccaagccaaataggccgt

SEQ ID NO: 108 - DNA, 4436 bp, Artificial Sequence
  Synthetic Polynucleotide
cactcggtcgctacgctccgggcgtgagactgcggcgggcgctgcggacacatacaaagttacccacagattccgtggataagcaggggactaacatgtgaggcaaaacagcagggccgcgccggtggcgtttttccataggctccgccctcctgccagagttcacataaacagacgcttttccggtgcatctgtgggagccgtgaggctcaaccatgaatctgacagtacgggcgaaacccgacaggacttaaagatccccaccgtttccggcgggtcgctccctcttgcgctctcctgttccgaccctgccgtttaccggatacctgttccgcctttctcccttacgggaagtgtggcgctttctcatagctcacacactggtatctcggctcggtgtaggtcgttcgctccaagctgggctgtaagcaagaactccccgttcagcccgactgctgcgccttatccggtaactgttcacttgagtccaacccggaaaagcacggtaaaacgccactggcagcagccattggtaactgggagttcgcagaggatttgtttagctaaacacgcggttgctcttgaagtgtgcgccaaagtccggctacactggaaggacagatttggttgctgtgctctgcgaaagccagttaccacggttaagcagttccccaactgacttaaccttcgatcaaaccacctccccaggtggttttttcgtttacagggcaaaagattacgcgcagaaaaaaaggatctcaagaagatcctttgatcttttctactgaaccgctctagatttcagtgcaatttatctcttcaaatgtagcacctgaagtcagcccaggaggaagaggacatccggtcaaataaaacgaaaggctcagtcgaaagactgggcctttcgttttagacttagggaccctttatgacaacttgacggctacatcattcactttttcttcacaaccggcacggaactcgctcgggctggccccggtgcattttttaaatacccgcgagaaatagagttgatcgtcaaaaccaacattgcgaccgacggtggcgataggcatccgggtggtgctcaaaagcagcttcgcctggctgatacgttggtcctcgcgccagcttaagacgctaatccctaactgctggcggaaaagatgtgacagacgcgacggcgacaagcaaacatgctgtgcgacgctggcaatatcaaaattgctgtctgccaggtgatcgctgatgtactgacaagcctcgcgtacccgattatccatcggtggatggagcgactcgttaatcgcttccatgcgccgcagtaacaattgctcaagcagatttatcgccagcagctccgaatagcgcccttccccttgcccggcgttaatgatttgcccaaacaggtcgctgaaatgcggctggtgcgcttcatccgggcgaaagaaccccgtattggcaaatattgacggccagttaagccattcatgccagtaggcgcgcggacgaaagtaaacccactggtgataccattcgcgagcctccggatgacgaccgtagtgatgaatctctcctggcgggaacagcaaaatatcacccggtcggcaaacaaattctcgtccctgatttttcaccaccccctgaccgcgaatggtgagattgagaatataacctttcattcccagcggtcggtcgataaaaaaatcgagataaccgttggcctcaatcggcgttaaacccgccaccagatgggcattaaacgagtatcccggcagcaggggatcattttgcgcttcagccatacttttcatactcccaccattcagagaagaaaccaattgtccatattgcatcagacattgccgtcactgcgtcttttactggctcttctcgctaacccaaccggtaaccccgcttattaaaagcattctgtaacaaagcgggaccaaagccatgacaaaaacgcgtaacaaaagtgtctataatcacggcagaaaagtccacattgattatttgcacggcgtcacactttgctatgccatagcatttttatccataagattagcggatcctacctgacgctttttatcgcaactctctactgtttctccatacccgtttttttggacgcgtacaactcaagtctgacataaatgaccgctatgagcactgcaattacacgccagatcgttctcgctaccgcaaccaccggtatgaaccagattggtgcgcactatgaaggccacaagatcattgagattggtgccgttgaagtggtgaaccgtcgcctgacgggcaataacttccatgtttatctcaaacccgatcggctggtggatccggaagcctttggcgtacatggtattgccgatgaatttttgctcgataagcccacgtttgccgaagtagccgatgagttcatggactatattcgcggcgcggagttggtgatccataacgcagcgttcgatatcggctttatggactacgagttttcgttgcttaagcgcgatattccgaagaccaatactttctgtaaggtcaccgatagccttgcggtggcgaggaaaatgtttcccggtaagcgcaacagcctcgatgcgttatgtgctcgctacgaaatagataacagtaaacgaacgctgcacggggcattactcgatgcccagatccttgcggaagtttatctggcgatgaccggtggtcaaacgtcgatggcttttgcgatggaaggagagacacaacagcaacaaggtgaagcaacaattcagcgcattgtacgtcaggcaagtaagttacgcgttgtttttgcgacagatgaagagattgcagctcatgaagcccgtctcgatctggtgcagaagaaaggcggaagttgcctctggcgagcataagtcgagattaagtaaaccggaatctgaagatgaaaggtcacctgacccgtctgggtctggaattcttcgaccagccggcggttccgctggcgcgtgcgttcctgggtcaggttctggttcgtcgtctgccgaacggtaccgaactgcgtggtcgtatcgttgaaaccgaagcgatcctgggtccggaagacgaagcggcgctgtctcgtggtggtcgtcagaccccgcgtaaccgtggtatgttcatgaaaccgggtaccctgtacgtttacatcatctacggtatgtacttctgcatgaacatctcttctcagggtgacggtgcgtgcgttctgctgcgtgcgctggaaccgctggaaggtctggaaaccatgcgtcagctgcgttctaccctgcgtaaaggtaccgcgtctcgtgttctgaaagaccgtgaactgtgctctggtccgtctaaactgtgccaggcgctggcgatcaacaaatctttcgaccagcgtgacctggcgcaggacgaagcggtttggctggaacgtggtccgctggaaccgtctgaaccggcggttgttgcggcggcgcgtgttggtgttggtcacgcgggtgaatgggcgcgtaaaccgctgcgtttctacgttcgtggttctccgtgggtttctgttgttgaccgtgttgcggaacaggacacccaggcgtaaacttaattaacggcactcctcagccaagtcaaaagcctccgaccggaggcttttgactacatgcccatggcgtttacgccccgccctgccactcatcgcagtactgttgtaattcattaagcattctgccgacatggaagccatcacaaacggcatgatgaacctgaatcgccagcggcatcagcaccttgtcgccttgcgtataatatttgcccatagtgaaaacgggggcgaagaagttgtccatattggccacgtttaaatcaaaactggtgaaactcacccagggattggctgagacgaaaaacatattctcaataaaccctttagggaaataggccaggttttcaccgtaacacgccacatcttgcgaatatatgtgtagaaactgccggaaatcgtcgtggtattcactccagagcgatgaaaacgtttcagtttgctcatggaaaacggtgtaacaagggtgaacactatcccatatcaccagctcaccgtctttcattgccatacggaactccggatgagcattcatcaggcgggcaagaatgtgaataaaggccggataaaacttgtgcttatttttctttacggtctttaaaaaggccgtaatatccagctgaacggtctggttataggtacattgagcaactgactgaaatgcctcaaaatgttctttacgatgccattgggatatatcaacggtggtatatccagtgatttttttctccattttagcttccttagctcctgaaaatctcgataactcaaaaaatacgcccggtagtgatcttatttcattatggtgaaagttggaacctcttacgtgccaagccaaataggccgt

SEQ ID NO: 109 - DNA, 4436 bp, Artificial Sequence; identical to SEQ ID NO: 108
  Synthetic Polynucleotide

SEQ ID NO: 110 - DNA, 6651 bp, Artificial Sequence
  Synthetic Polynucleotide
cactcggtcgctacgctccgggcgtgagactgcggcgggcgctgcggacacatacaaagttacccacagattccgtggataagcaggggactaacatgtgaggcaaaacagcagggccgcgccggtggcgtttttccataggctccgccctcctgccagagttcacataaacagacgcttttccggtgcatctgtgggagccgtgaggctcaaccatgaatctgacagtacgggcgaaacccgacaggacttaaagatccccaccgtttccggcgggtcgctccctcttgcgctctcctgttccgaccctgccgtttaccggatacctgttccgcctttctcccttacgggaagtgtggcgctttctcatagctcacacactggtatctcggctcggtgtaggtcgttcgctccaagctgggctgtaagcaagaactccccgttcagcccgactgctgcgccttatccggtaactgttcacttgagtccaacccggaaaagcacggtaaaacgccactggcagcagccattggtaactgggagttcgcagaggatttgtttagctaaacacgcggttgctcttgaagtgtgcgccaaagtccggctacactggaaggacagatttggttgctgtgctctgcgaaagccagttaccacggttaagcagttccccaactgacttaaccttcgatcaaaccacctccccaggtggttttttcgtttacagggcaaaagattacgcgcagaaaaaaaggatctcaagaagatcctttgatcttttctactgaaccgctctagatttcagtgcaatttatctcttcaaatgtagcacctgaagtcagcccaggaggaagaggacatccggtcaaataaaacgaaaggctcagtcgaaagactgggcctttcgttttagacttagggaccctttatgacaacttgacggctacatcattcactttttcttcacaaccggcacggaactcgctcgggctggccccggtgcattttttaaatacccgcgagaaatagagttgatcgtcaaaaccaacattgcgaccgacggtggcgataggcatccgggtggtgctcaaaagcagcttcgcctggctgatacgttggtcctcgcgccagcttaagacgctaatccctaactgctggcggaaaagatgtgacagacgcgacggcgacaagcaaacatgctgtgcgacgctggcgatatcaaaattgctgtctgccaggtgatcgctgatgtactgacaagcctcgcgtacccgattatccatcggtggatggagcgactcgttaatcgcttccatgcgccgcagtaacaattgctcaagcagatttatcgccagcagctccgaatagcgcccttccccttgcccggcgttaatgatttgcccaaacaggtcgctgaaatgcggctggtgcgcttcatccgggcgaaagaaccccgtattggcaaatattgacggccagttaagccattcatgccagtaggcgcgcggacgaaagtaaacccactggtgataccattcgcgagcctccggatgacgaccgtagtgatgaatctctcctggcgggaacagcaaaatatcacccggtcggcaaacaaattctcgtccctgatttttcaccaccccctgaccgcgaatggtgagattgagaatataacctttcattcccagcggtcggtcgataaaaaaatcgagataaccgttggcctcaatcggcgttaaacccgccaccagatgggcattaaacgagtatcccggcagcaggggatcattttgcgcttcagccatacttttcatactcccaccattcagagaagaaaccaattgtccatattgcatcagacattgccgtcactgcgtcttttactggctcttctcgctaacccaaccggtaaccccgcttattaaaagcattctgtaacaaagcgggaccaaagccatgacaaaaacgcgtaacaaaagtgtctataatcacggcagaaaagtccacattgattatttgcacggcgtcacactttgctatgccatagcatttttatccataagattagcggatcctacctgacgctttttatcgcaactctctactgtttctccatacccgtttttttggacgcgtacaactcaagtctgacataaatgaccgctatgagcactgcaattacacgccagatcgttctcgctaccgcaaccaccggtatgaaccagattggtgcgcactatgaaggccacaagatcattgagattggtgccgttgaagtggtgaaccgtcgcctgacgggcaataacttccatgtttatctcaaacccgatcggctggtggatccggaagcctttggcgtacatggtattgccgatgaatttttgctcgataagcccacgtttgccgaagtagccgatgagttcatggactatattcgcggcgcggagttggtgatccataacgcagcgttcgatatcggctttatggactacgagttttcgttgcttaagcgcgatattccgaagaccaatactttctgtaaggtcaccgatagccttgcggtggcgaggaaaatgtttcccggtaagcgcaacagcctcgatgcgttatgtgctcgctacgaaatagataacagtaaacgaacgctgcacggggcattactcgatgcccagatccttgcggaagtttatctggcgatgaccggtggtcaaacgtcgatggcttttgcgatggaaggagagacacaacagcaacaaggtgaagcaacaattcagcgcattgtacgtcaggcaagtaagttacgcgttgtttttgcgacagatgaagagattgcagctcatgaagcccgtctcgatctggtgcagaagaaaggcggaagttgcctctggcgagcataatttaatatcagtaaaccggacataacccatgaagaaaaatcgcgcttttttgaagtgggcagggggcaagtatcccctgcttgatgatattaaacggcatttgcccaagggcgaatgtctggttgagccttttgtaggtgccgggtcggtgtttctcaacaccgacttttctcgttatatccttgccgatatcaatagcgacctgatcagtctctataacattgtgaagatgcgtactgatgagtacgtacaggccgcacgcgagctgtttgttcccgaaacaaattgcgccgaggtttactatcagttccgcgaagagttcaacaaaagccaggatccgttccgtcgggcggtactgtttttatatttgaaccgctacggttacaacggcctgtgtcgttacaatctgcgcggtgagtttaacgtgccgttcggccgctacaaaaaaccctatttcccggaagcagagttgtatcacttcgctgaaaaagcgcagaatgcctttttctattgtgagtcttacgccgatagcatggcgcgcgcagatgatgcatccgtcgtctattgcgatccgccttatgcaccgctgtctgcgaccgccaactttacggcgtatcacacaaacagttttacgcttgaacaacaagcgcatctggcggagatcgccgaaggtctggttgagcgccatattccagtgctgatctccaatcacgatacgatgttaacgcgtgagtggtatcagcgcgcaaaattgcatgtcgtcaaagttcgacgcagtataagcagcaacggcggcacacgtaaaaaggtggacgaactgctggctttgtacaaaccaggagtcgtttcacccgcgaaaaaataattcagctaagacactgcactggattaagatgaaaacgattgaagttgatgatgaactctacagctatattgccagccacactaagcatatcggcgagagcgcatccgacattttacggcgtatgttgaaattttccgccgcatcacagcctgctgctccggtgacgaaagaggttcgcgttgcgtcacctgctatcgtcgaagcgaagccggtcaaaacgattaaagacaaggttcgcgcaatgcgtgaacttctgctttcggatgaatacgcagagcaaaagcgagcggtcaatcgctttatgctgctgttgtctacactatattctcttgacgcccaggcgtttgccgaagcaacggaatcgttgcacggtcgtacacgcgtttactttgcggcagatgaacaaacgctgctgaaaaatggtaatcagaccaagccgaaacatgtgccaggcacgccgtattgggtgatcaccaacaccaacaccggccgtaaatgcagcatgatcgaacacatcatgcagtcgatgcaattcccggcggaattgattgagaaggtttgcggaactatctaacggctgaaattaatgaggtcatacccaaatggatagttcgtttacgcccattgaacaaatgctaaaatttcgcgccagccgccacgaagattttccttatcaggagatccttctgactcgtctttgcatgcacatgcaaagcaagctgctggagaaccgcaataaaatgctgaaggctcagggaattaacgagacgttgtttatggcgttgattacgctggagtctcaggaaaaccacagtattcagccttctgaattaagttgtgctcttggatcatcccgtaccaacgcgacgcgtattgccgatgaactggaaaaacgcggttggatcgaacgtcgtgaaagcgataacgatcgccgctgcctgcatctgcaattaacggaaaaaggtcacgagtttttgcgcgaggttttaccaccgcagcataactgcctgcatcaactctggtccgcgctcagcacaacagaaaaagatcagctcgagcaaatcacccgcaaattgctctcccgtctcgaccagatggaacaagacggtgtggttctcgaagcgatgagctaataatacaaaaattaggaggaatttcaacatgacaaatttatctgacatcattgaaaaagaaacaggaaaacaactagtgattcaagaatcaattctaatgttaccagaagaagtagaggaagtaattgggaataaaccagaaagtgatattttagttcatactgcttatgatgaaagtacagatgaaaatgtaatgctattaacttcagatgctccagaatataaaccttgggctttagtaattcaagacagtaatggagaaaataaaattaaaatgttataagtcgagattaagtaaaccggaatctgaagatggactctctgctgatgaaccgtcgtgaattcctgtaccagttcaaaaacgttcgttgggcgaaaggtcgtcgtgaaacctacctgtgctacgttgttaaacgtcgtgactctgcgacctctttctctctggacttcggttacctgcgtaacaaaaacggttgccacgttgaactgctgttcctgcgttacatctctgactgggacctggacccgggtcgttgctaccgtgttacctggttcatctcttggtctccgtgctacgactgcgcgcgtcacgttgcggacttcctgcgtggtaacccgaacctgtctctgcgtatcttcaccgcgcgtctgtacttctgcgaagaccgtaaagcggaaccggaaggtctgcgtcgtctgcaccgtgcgggtgttcagatcgcgatcatgaccttcaaagactacttctactgctggaacaccttcgttgaaaaccacggccgtaccttcaaagcgtgggaaggtctgcacgaaaactctgttcgtctgtctcgtcagctgcgtcgtatcctgctgccgctgtacgaagttgacgacctgcgtgacgcgttccgtaccctgggtctgtaaacttaattaacggcactcctcagccaagtcaaaagcctccgaccggaggcttttgactacatgcccatggcgtttacgccccgccctgccactcatcgcagtactgttgtaattcattaagcattctgccgacatggaagccatcacaaacggcatgatgaacctgaatcgccagcggcatcagcaccttgtcgccttgcgtataatatttgcccatagtgaaaacgggggcgaagaagttgtccatattggccacgtttaaatcaaaactggtgaaactcacccagggattggctgagacgaaaaacatattctcaataaaccctttagggaaataggccaggttttcaccgtaacacgccacatcttgcgaatatatgtgtagaaactgccggaaatcgtcgtggtattcactccagagcgatgaaaacgtttcagtttgctcatggaaaacggtgtaacaagggtgaacactatcccatatcaccagctcaccgtctttcattgccatacggaactccggatgagcattcatcaggcgggcaagaatgtgaataaaggccggataaaacttgtgcttatttttctttacggtctttaaaaaggccgtaatatccagctgaacggtctggttataggtacattgagtaactgactgaaatgcctcaaaatgttctttacgatgccattgggatatatcaacggtggtatatccagtgatttttttctccattttagcttccttagctcctgaaaatctcgataactcaaaaaatacgcccggtagtgatcttatttcattatggtgaaagttggaacctcttacgtgccaagccaaataggccgt

SEQ ID NO: 111 - DNA, 6651 bp, Artificial Sequence
  Synthetic Polynucleotide
cactcggtcgctacgctccgggcgtgagactgcggcgggcgctgcggacacatacaaagttacccacagattccgtggataagcaggggactaacatgtgaggcaaaacagcagggccgcgccggtggcgtttttccataggctccgccctcctgccagagttcacataaacagacgcttttccggtgcatctgtgggagccgtgaggctcaaccatgaatctgacagtacgggcgaaacccgacaggacttaaagatccccaccgtttccggcgggtcgctccctcttgcgctctcctgttccgaccctgccgtttaccggatacctgttccgcctttctcccttacgggaagtgtggcgctttctcatagctcacacactggtatctcggctcggtgtaggtcgttcgctccaagctgggctgtaagcaagaactccccgttcagcccgactgctgcgccttatccggtaactgttcacttgagtccaacccggaaaagcacggtaaaacgccactggcagcagccattggtaactgggagttcgcagaggatttgtttagctaaacacgcggttgctcttgaagtgtgcgccaaagtccggctacactggaaggacagatttggttgctgtgctctgcgaaagccagttaccacggttaagcagttccccaactgacttaaccttcgatcaaaccacctccccaggtggttttttcgtttacagggcaaaagattacgcgcagaaaaaaaggatctcaagaagatcctttgatcttttctactgaaccgctctagatttcagtgcaatttatctcttcaaatgtagcacctgaagtcagcccaggaggaagaggacatccggtcaaataaaacgaaaggctcagtcgaaagactgggcctttcgttttagacttagggaccctttatgacaacttgacggctacatcattcactttttcttcacaaccggcacggaactcgctcgggctggccccggtgcattttttaaatacccgcgagaaatagagttgatcgtcaaaaccaacattgcgaccgacggtggcgataggcatccgggtggtgctcaaaagcagcttcgcctggctgatacgttggtcctcgcgccagcttaagacgctaatccctaactgctggcggaaaagatgtgacagacgcgacggcgacaagcaaacatgctgtgcgacgctggcgatatcaaaattgctgtctgccaggtgatcgctgatgtactgacaagcctcgcgtacccgattatccatcggtggatggagcgactcgttaatcgcttccatgcgccgcagtaacaattgctcaagcagatttatcgccagcagctccgaatagcgcccttccccttgcccggcgttaatgatttgcccaaacaggtcgctgaaatgcggctggtgcgcttcatccgggcgaaagaaccccgtattggcaaatattgacggccagttaagccattcatgccagtaggcgcgcggacgaaagtaaacccactggtgataccattcgcgagcctccggatgacgaccgtagtgatgaatctctcctggcgggaacagcaaaatatcacccggtcggcaaacaaattctcgtccctgatttttcaccaccccctgaccgcgaatggtgagattgagaatataacctttcattcccagcggtcggtcgataaaaaaatcgagataaccgttggcctcaatcggcgttaaacccgccaccagatgggcattaaacgagtatcccggcagcaggggatcattttgcgcttcagccatacttttcatactcccaccattcagagaagaaaccaattgtccatattgcatcagacattgccgtcactgcgtcttttactggctcttctcgctaacccaaccggtaaccccgcttattaaaagcattctgtaacaaagcgggaccaaagccatgacaaaaacgcgtaacaaaagtgtctataatcacggcagaaaagtccacattgattatttgcacggcgtcacactttgctatgccatagcatttttatccataagattagcggatcctacctgacgctttttatcgcaactctctactgtttctccatacccgtttttttggacgcgtacaactcaagtctgacataaatgaccgctatgagcactgcaattacacgccagatcgttctcgctaccgcaaccaccggtatgaaccagattggtgcgcactatgaaggccacaagatcattgagattggtgccgttgaagtggtgaaccgtcgcctgacgggcaataacttccatgtttatctcaaacccgatcggctggtggatccggaagcctttggcgtacatggtattgccgatgaatttttgctcgataagcccacgtttgccgaagtagccgatgagttcatggactatattcgcggcgcggagttggtgatccataacgcagcgttcgatatcggctttatggactacgagttttcgttgcttaagcgcgatattccgaagaccaatactttctgtaaggtcaccgatagccttgcggtggcgaggaaaatgtttcccggtaagcgcaacagcctcgatgcgttatgtgctcgctacgaaatagataacagtaaacgaacgctgcacggggcattactcgatgcccagatccttgcggaagtttatctggcgatgaccggtggtcaaacgtcgatggcttttgcgatggaaggagagacacaacagcaacaaggtgaagcaacaattcagcgcattgtacgtcaggcaagtaagttacgcgttgtttttgcgacagatgaagagattgcagctcatgaagcccgtctcgatctggtgcagaagaaaggcggaagttgcctctggcgagcataatttaatatcagtaaaccggacataacccatgaagaaaaatcgcgcttttttgaagtgggcagggggcaagtatcccctgcttgatgatattaaacggcatttgcccaagggcgaatgtctggttgagccttttgtaggtgccgggtcggtgtttctcaacaccgacttttctcgttatatccttgccgatatcaatagcgacctgatcagtctctataacattgtgaagatgcgtactgatgagtacgtacaggccgcacgcgagctgtttgttcccgaaacaaattgcgccgaggtttactatcagttccgcgaagagttcaacaaaagccaggatccgttccgtcgggcggtactgtttttatatttgaaccgctacggttacaacggcctgtgtcgttacaatctgcgcggtgagtttaacgtgccgttcggccgctacaaaaaaccctatttcccggaagcagagttgtatcacttcgctgaaaaagcgcagaatgcctttttctattgtgagtcttacgccgatagcatggcgcgcgcagatgatgcatccgtcgtctattgcgatccgccttatgcaccgctgtctgcgaccgccaactttacggcgtatcacacaaacagttttacgcttgaacaacaagcgcatctggcggagatcgccgaaggtctggttgagcgccatattccagtgctgatctccaatcacgatacgatgttaacgcgtgagtggtatcagcgcgcaaaattgcatgtcgtcaaagttcgacgcagtataagcagcaacggcggcacacgtaaaaaggtggacgaactgctggctttgtacaaaccaggagtcgtttcacccgcgaaaaaataattcagctaagacactgcactggattaagatgaaaacgattgaagttgatgatgaactctacagctatattgccagccacactaagcatatcggcgagagcgcatccgacattttacggcgtatgttgaaattttccgccgcatcacagcctgctgctccggtgacgaaagaggttcgcgttgcgtcacctgctatcgtcgaagcgaagccggtcaaaacgattaaagacaaggttcgcgcaatgcgtgaacttctgctttcggatgaatacgcagagcaaaagcgagcggtcaatcgctttatgctgctgttgtctacactatattctcttgacgcccaggcgtttgccgaagcaacggaatcgttgcacggtcgtacacgcgtttactttgcggcagatgaacaaacgctgctgaaaaatggtaatcagaccaagccgaaacatgtgccaggcacgccgtattgggtgatcaccaacaccaacaccggccgtaaatgcagcatgatcgaacacatcatgcagtcgatgcaattcccggcggaattgattgagaaggtttgcggaactatctaacggctgaaattaatgaggtcatacccaaatggatagttcgtttacgcccattgaacaaatgctaaaatttcgcgccagccgccacgaagattttccttatcaggagatccttctgactcgtctttgcatgcacatgcaaagcaagctgctggagaaccgcaataaaatgctgaaggctcagggaattaacgagacgttgtttatggcgttgattacgctggagtctcaggaaaaccacagtattcagccttctgaattaagttgtgctcttggatcatcccgtaccaacgcgacgcgtattgccgatgaactggaaaaacgcggttggatcgaacgtcgtgaaagcgataacgatcgccgctgcctgcatctgcaattaacggaaaaaggtcacgagtttttgcgcgaggttttaccaccgcagcataactgcctgcatcaactctggtccgcgctcagcacaacagaaaaagatcagctcgagcaaatcacccgcaaattgctctcccgtctcgaccagatggaacaagacggtgtggttctcgaagcgatgagctaataatacaaaaattaggaggaatttcaacatgacaaatttatctgacatcattgaaaaagaaacaggaaaacaactagtgattcaagaatcaattctaatgttaccagaagaagtagaggaagtaattgggaataaaccagaaagtgatattttagttcatactgcttatgatgaaagtacagatgaaaatgtaatgctattaacttcagatgctccagaatataaaccttgggctttagtaattcaagacagtaatggagaaaataaaattaaaatgttataagtcgagattaagtaaaccggaatctgaagatggactctctgctgatgaaccgtcgtgaattcctgtaccagttcaaaaacgttcgttgggcgaaaggtcgtcgtgaaacctacctgtgctacgttgttgaaagccgtgactctgcgacctctttctctctggacttcggttacctgcgtaacaaaaacggttgccacgttgaaatgctgttcctgcgttacatctctgactgggacctggacccgggtcgttgctaccgtgttacctggttcatctcttggtctccgtgctacgactgcgcgcgtcacgttgcggacttcctgcgtggtaacccgaacctgtctctgcgtatcttcaccgcgcgtctgtacttctgcgaagaccgtcgtgcggaaccggaaggtctgcgtcgtctgcaccgtgcgggtgttcagatcgcgatcatgaccttcaaagactacttctactgctggaacaccttcgttgaaaaccacggcatcaccttcaaagcgtgggaaggtctgcacgaaaactctgttcgtctgtctcgtcagctgcgtcgtatcctgctgccgctgtacgaagttgacgacctgcgtgacgcgttccgtaccctgggtctgtaaacttaattaacggcactcctcagccaagtcaaaagcctccgaccggaggcttttgactacatgcccatggcgtttacgccccgccctgccactcatcgcagtactgttgtaattcattaagcattctgccgacatggaagccatcacaaacggcatgatgaacctgaatcgccagcggcatcagcaccttgtcgccttgcgtataatatttgcccatagtgaaaacgggggcgaagaagttgtccatattggccacgtttaaatcaaaactggtgaaactcacccagggattggctgagacgaaaaacatattctcaataaaccctttagggaaataggccaggttttcaccgtaacacgccacatcttgcgaatatatgtgtagaaactgccggaaatcgtcgtggtattcactccagagcgatgaaaacgtttcagtttgctcatggaaaacggtgtaacaagggtgaacactatcccatatcaccagctcaccgtctttcattgccatacggaactccggatgagcattcatcaggcgggcaagaatgtgaataaaggccggataaaacttgtgcttatttttctttacggtctttaaaaaggccgtaatatccagctgaacggtctggttataggtacattgagtaactgactgaaatgcctcaaaatgttctttacgatgccattgggatatatcaacggtggtatatccagtgatttttttctccattttagcttccttagctcctgaaaatctcgataactcaaaaaatacgcccggtagtgatcttatttcattatggtgaaagttggaacctcttacgtgccaagccaaataggccgt

SEQ ID NO: 112 - DNA, 6651 bp, Artificial Sequence
  Synthetic Polynucleotide
cactcagtcgctacgctccgggcgtgagactgcggcgggcgctgcggacacatacaaagttacccacagattccgtggataagcaggggactaacatgtgaggcaaaacagcagggccgcgccggtggcgtttttccataggctccgccctcctgccagagttcacataaacagacgcttttccggtgcatctgtgggagccgtgaggctcaaccatgaatctgacagtacgggcgaaacccgacaggacttaaagatccccaccgtttccggcgggtcgctccctcttgcgctctcctgttccgaccctgccgtttaccggatacctgttccgcctttctcccttacgggaagtgtggcgctttctcatagctcacacactggtatctcggctcggtgtaggtcgttcgctccaagctgggctgtaagcaagaactccccgttcagcccgactgctgcgccttatccggtaactgttcacttgagtccaacccggaaaagcacggtaaaacgccactggcagcagccattggtaactgggagttcgcagaggatttgtttagctaaacacgcggttgctcttgaagtgtgcgccaaagtccggctacactggaaggacagatttggttgctgtgctctgcgaaagccagttaccacggttaagcagttccccaactgacttaaccttcgatcaaaccacctccccaggtggttttttcgtttacagggcaaaagattacgcgcagaaaaaaaggatctcaagaagatcctttgatcttttctactgaaccgctctagatttcagtgcaatttatctcttcaaatgtagcacctgaagtcagcccaggaggaagaggacatccggtcaaataaaacgaaaggctcagtcgaaagactgggcctttcgttttagacttagggaccctttatgacaacttgacggctacatcattcactttttcttcacaaccggcacggaactcgctcgggctggccccggtgcattttttaaatacccgcgagaaatagagttgatcgtcaaaaccaacattgcgaccgacggtggcgataggcatccgggtggtgctcaaaagcagcttcgcctggctgatacgttggtcctcgcgccagcttaagacgctaatccctaactgctggcggaaaagatgtgacagacgcgacggcgacaagcaaacatgctgtgcgacgctggcgatatcaaaattgctgtctgccaggtgatcgctgatgtactgacaagcctcgcgtacccgattatccatcggtggatggagcgactcgttaatcgcttccatgcgccgcagtaacaattgctcaagcagatttatcgccagcagctccgaatagcgcccttccccttgcccggcgttaatgatttgcccaaacaggtcgctgaaatgcggctggtgcgcttcatccgggcgaaagaaccccgtattggcaaatattgacggccagttaagccattcatgccagtaggcgcgcggacgaaagtaaacccactggtgataccattcgcgagcctccggatgacgaccgtagtgatgaatctctcctggcgggaacagcaaaatatcacccggtcggcaaacaaattctcgtccctgatttttcaccaccccctgaccgcgaatggtgagattgagaatataacctttcattcccagcggtcggtcgataaaaaaatcgagataaccgttggcctcaatcggcgttaaacccgccaccagatgggcattaaacgagtatcccggcagcaggggatcattttgcgcttcagccatacttttcatactcccaccattcagagaagaaaccaattgtccatattgcatcagacattgccgtcactgcgtcttttactggctcttctcgctaacccaaccggtaaccccgcttattaaaagcattctgtaacaaagcgggaccaaagccatgacaaaaacgcgtaacaaaagtgtctataatcacggcagaaaagtccacattgattatttgcacggcgtcacactttgctatgccatagcatttttatccataagattagcggatcctacctgacgctttttatcgcaactctctactgtttctccatacccgtttttttggacgcgtacaactcaagtctgacataaatgaccgctatgagcactgcaattacacgccagatcgttctcgctaccgcaaccaccggtatgaaccagattggtgcgcactatgaaggccacaagatcattgagattggtgccgttgaagtggtgaaccgtcgcctgacgggcaataacttccatgtttatctcaaacccgatcggctggtggatccggaagcctttggcgtacatggtattgccgatgaatttttgctcgataagcccacgtttgccgaagtagccgatgagttcatggactatattcgcggcgcggagttggtgatccataacgcagcgttcgatatcggctttatggactacgagttttcgttgcttaagcgcgatattccgaagaccaatactttctgtaaggtcaccgatagccttgcggtggcgaggaaaatgtttcccggtaagcgcaacagcctcgatgcgttatgtgctcgctacgaaatagataacagtaaacgaacgctgcacggggcattactcgatgcccagatccttgcggaagtttatctggcgatgaccggtggtcaaacgtcgatggcttttgcgatggaaggagagacacaacagcaacaaggtgaagcaacaattcagcgcattgtacgtcaggcaagtaagttacgcgttgtttttgcgacagatgaagagattgcagctcatgaagcccgtctcgatctggtgcagaagaaaggcggaagttgcctctggcgagcataatttaatatcagtaaaccggacataacccatgaagaaaaatcgcgcttttttgaagtgggcagggggcaagtatcccctgcttgatgatattaaacggcatttgcccaagggcgaatgtctggttgagccttttgtaggtgccgggtcggtgtttctcaacaccgacttttctcgttatatccttgccgatatcaatagcgacctgatcagtctctataacattgtgaagatgcgtactgatgagtacgtacaggccgcacgcgagctgtttgttcccgaaacaaattgcgccgaggtttactatcagttccgcgaagagttcaacaaaagccaggatccgttccgtcgggcggtactgtttttatatttgaaccgctacggttacaacggcctgtgtcgttacaatctgcgcggtgagtttaacgtgccgttcggccgctacaaaaaaccctatttcccggaagcagagttgtatcacttcgctgaaaaagcgcagaatgcctttttctattgtgagtcttacgccgatagcatggcgcgcgcagatgatgcatccgtcgtctattgcgatccgccttatgcaccgctgtctgcgaccgccaactttacggcgtatcacacaaacagttttacgcttgaacaacaagcgcatctggcggagatcgccgaaggtctggttgagcgccatattccagtgctgatctccaatcacgatacgatgttaacgcgtgagtggtatcagcgcgcaaaattgcatgtcgtcaaagttcgacgcagtataagcagcaacggcggcacacgtaaaaaggtggacgaactgctggctttgtacaaaccaggagtcgtttcacccgcgaaaaaataattcagctaagacactgcactggattaagatgaaaacgattgaagttgatgatgaactctacagctatattgccagccacactaagcatatcggcgagagcgcatccgacattttacggcgtatgttgaaattttccgccgcatcacagcctgctgctccggtgacgaaagaggttcgcgttgcgtcacctgctatcgtcgaagcgaagccggtcaaaacgattaaagacaaggttcgcgcaatgcgtgaacttctgctttcggatgaatacgcagagcaaaagcgagcggtcaatcgctttatgctgctgttgtctacactatattctcttgacgcccaggcgtttgccgaagcaacggaatcgttgcacggtcgtacacgcgtttactttgcggcagatgaacaaacgctgctgaaaaatggtaatcagaccaagccgaaacatgtgccaggcacgccgtattgggtgatcaccaacaccaacaccggccgtaaatgcagcatgatcgaacacatcatgcagtcgatgcaattcccggcggaattgattgagaaggtttgcggaactatctaacggctgaaattaatgaggtcatacccaaatggatagttcgtttacgcccattgaacaaatgctaaaatttcgcgccagccgccacgaagattttccttatcaggagatccttctgactcgtctttgcatgcacatgcaaagcaagctgctggagaaccgcaataaaatgctgaaggctcagggaattaacgagacgttgtttatggcgttgattacgctggagtctcaggaaaaccacagtattcagccttctgaattaagttgtgctcttggatcatcccgtaccaacgcgacgcgtattgccgatgaactggaaaaacgcggttggatcgaacgtcgtgaaagcgataacgatcgccgctgcctgcatctgcaattaacggaaaaaggtcacgagtttttgcgcgaggttttaccaccgcagcataactgcctgcatcaactctggtccgcgctcagcacaacagaaaaagatcagctcgagcaaatcacccgcaaattgctctcccgtctcgaccagatggaacaagacggtgtggttctcgaagcgatgagctaataatacaaaaattaggaggaatttcaacatgacaaatttatctgacatcattgaaaaagaaacaggaaaacaactagtgattcaagaatcaattctaatgttaccagaagaagtagaggaagtaattgggaataaaccagaaagtgatattttagttcatactgcttatgatgaaagtacagatgaaaatgtaatgctattaacttcagatgctccagaatataaaccttgggctttagtaattcaagacagtaatggagaaaataaaattaaaatgttataagtcgagattaagtaaaccggaatctgaagatggactctctgctgatgaaccgtcgtgaattcctgtaccagtataaaaacgttcgttgggcgaaaggtcgtcgtgaaacctacctgtgctacgttgttaaacgtcgtgactctgcgacctctttctctctggacttcggttacctgcgtaacaaaaacggttgccacgttgaactgctgttcctgcgttacatctctgactgggacctggacccgggtcgttgctaccgtgttacctggttcatctcttggtctccgtgctacgactgcgcgcgtcacgttgcggacttcctgcgtggtaacccgaacctgtctctgcgtatcttcaccgcgcgtctgtactattgcgaagaccgtaaagcggaaccggaaggtctgcgtcgtctgcaccgtgcgggtgttcagatcgcgatcatgaccttcaaagactacttctactgctggaacaccttcgttgaaaaccacggccgtaccttcaaagcgtgggaaggtctgcacgaaaactctgttcgtctgtctcgtcagctgcgtcgtatcctgctgccgctgtacggcgttgacgacctgcgtgacgcgttccgtaccctgggtctgtaaacttaattaacggcactcctcagccaagtcaaaagcctccgaccggaggcttttgactacatgcccatggcgtttacgccccgccctgccactcatcgcagtactgttgtaattcattaagcattctgccgacatggaagccatcacaaacggcatgatgaacctgaatcgccagcggcatcagcaccttgtcgccttgcgtataatatttgcccatagtgaaaacgggggcgaagaagttgtccatattggccacgtttaaatcaaaactggtgaaactcacccagggattggctgagacgaaaaacatattctcaataaaccctttagggaaataggccaggttttcaccgtaacacgccacatcttgcgaatatatgtgtagaaactgccggaaatcgtcgtggtattcactccagagcgatgaaaacgtttcagtttgctcatggaaaacggtgtaacaagggtgaacactatcccatatcaccagctcaccgtctttcattgccatacggaactccggatgagcattcatcaggcgggcaagaatgtgaataaaggccggataaaacttgtgcttatttttctttacggtctttaaaaaggccgtaatatccagctgaacggtctggttataggtacattgagtaactgactgaaatgcctcaaaatgttctttacgatgccattgggatatatcaacggtggtatatccagtgatttttttctccattttagcttccttagctcctgaaaatctcgataactcaaaaaatacgcccggtagtgatcttatttcattatggtgaaagttggaacctcttacgtgccaagccaaataggccgt

SEQ ID NO: 113 - DNA, 6651 bp, Artificial Sequence
  Synthetic Polynucleotide
cactcggtcgctacgctccgggcgtgagactgcggcgggcgctgcggacacatacaaagttacccacagattccgtggataagcaggggactaacatgtgaggcaaaacagcagggccgcgccggtggcgtttttccataggctccgccctcctgccagagttcacataaacagacgcttttccggtgcatctgtgggagccgtgaggctcaaccatgaatctgacagtacgggcgaaacccgacaggacttaaagatccccaccgtttccggcgggtcgctccctcttgcgctctcctgttccgaccctgccgtttaccggatacctgttccgcctttctcccttacgggaagtgtggcgctttctcatagctcacacactggtatctcggctcggtgtaggtcgttcgctccaagctgggctgtaagcaagaactccccgttcagcccgactgctgcgccttatccggtaactgttcacttgagtccaacccggaaaagcacggtaaaacgccactggcagcagccattggtaactgggagttcgcagaggatttgtttagctaaacacgcggttgctcttgaagtgtgcgccaaagtccggctacactggaaggacagatttggttgctgtgctctgcgaaagccagttaccacggttaagcagttccccaactgacttaaccttcgatcaaaccacctccccaggtggttttttcgtttacagggcaaaagattacgcgcagaaaaaaaggatctcaagaagatcctttgatcttttctactgaaccgctctagatttcagtgcaatttatctcttcaaatgtagcacctgaagtcagcccaggaggaagaggacatccggtcaaataaaacgaaaggctcagtcgaaagactgggcctttcgttttagacttagggaccctttatgacaacttgacggctacatcattcactttttcttcacaaccggcacggaactcgctcgggctggccccggtgcattttttaaatacccgcgagaaatagagttgatcgtcaaaaccaacattgcgaccgacggtggcgataggcatccgggtggtgctcaaaagcagcttcgcctggctgatacgttggtcctcgcgccagcttaagacgctaatccctaactgctggcggaaaagatgtgacagacgcgacggcgacaagcaaacatgctgtgcgacgctggcgatatcaaaattgctgtctgccaggtgatcgctgatgtactgacaagcctcgcgtacccgattatccatcggtggatggagcgactcgttaatcgcttccatgcgccgcagtaacaattgctcaagcagatttatcgccagcagctccgaatagcgcccttccccttgcccggcgttaatgatttgcccaaacaggtcgctgaaatgcggctggtgcgcttcatccgggcgaaagaaccccgtattggcaaatattgacggccagttaagccattcatgccagtaggcgcgcggacgaaagtaaacccactggtgataccattcgcgagcctccggatgacgaccgtagtgatgaatctctcctggcgggaacagcaaaatatcacccggtcggcaaacaaattctcgtccctgatttttcaccaccccctgaccgcgaatggtgagattgagaatataacctttcattcccagcggtcggtcgataaaaaaatcgagataaccgttggcctcaatcggcgttaaacccgccaccagatgggcattaaacgagtatcccggcagcaggggatcattttgcgcttcagccatacttttcatactcccaccattcagagaagaaaccaattgtccatattgcatcagacattgccgtcactgcgtcttttactggctcttctcgctaacccaaccggtaaccccgcttattaaaagcattctgtaacaaagcgggaccaaagccatgacaaaaacgcgtaacaaaagtgtctataatcacggcagaaaagtccacattgattatttgcacggcgtcacactttgctatgccatagcatttttatccataagattagcggatcctacctgacgctttttatcgcaactctctactgtttctccatacccgtttttttggacgcgtacaactcaagtctgacataaatgaccgctatgagcactgcaattacacgccagatcgttctcgctaccgcaaccaccggtatgaaccagattggtgcgcactatgaaggccacaagatcattgagattggtgccgttgaagtggtgaaccgtcgcctgacgggcaataacttccatgtttatctcaaacccgatcggctggtggatccggaagcctttggcgtacatggtattgccgatgaatttttgctcgataagcccacgtttgccgaagtagccgatgagttcatggactatattcgcggcgcggagttggtgatccataacgcagcgttcgatatcggctttatggactacgagttttcgttgcttaagcgcgatattccgaagaccaatactttctgtaaggtcaccgatagccttgcggtggcgaggaaaatgtttcccggtaagcgcaacagcctcgatgcgttatgtgctcgctacgaaatagataacagtaaacgaacgctgcacggggcattactcgatgcccagatccttgcggaagtttatctggcgatgaccggtggtcaaacgtcgatggcttttgcgatggaaggagagacacaacagcaacaaggtgaagcaacaattcagcgcattgtacgtcaggcaagtaagttacgcgttgtttttgcgacagatgaagagattgcagctcatgaagcccgtctcgatctggtgcagaagaaaggcggaagttgcctctggcgagcataatttaatatcagtaaaccggacataacccatgaagaaaaatcgcgcttttttgaagtgggcagggggcaagtatcccctgcttgatgatattaaacggcatttgcccaagggcgaatgtctggttgagccttttgtaggtgccgggtcggtgtttctcaacaccgacttttctcgttatatccttgccgatatcaatagcgacctgatcagtctctataacattgtgaagatgcgtactgatgagtacgtacaggccgcacgcgagctgtttgttcccgaaacaaattgcgccgaggtttactatcagttccgcgaagagttcaacaaaagccaggatccgttccgtcgggcggtactgtttttatatttgaaccgctacggttacaacggcctgtgtcgttacaatctgcgcggtgagtttaacgtgccgttcggccgctacaaaaaaccctatttcccggaagcagagttgtatcacttcgctgaaaaagcgcagaatgcctttttctattgtgagtcttacgccgatagcatggcgcgcgcagatgatgcatccgtcgtctattgcgatccgccttatgcaccgctgtctgcgaccgccaactttacggcgtatcacacaaacagttttacgcttgaacaacaagcgcatctggcggagatcgccgaaggtctggttgagcgccatattccagtgctgatctccaatcacgatacgatgttaacgcgtgagtggtatcagcgcgcaaaattgcatgtcgtcaaagttcgacgcagtataagcagcaacggcggcacacgtaaaaaggtggacgaactgctggctttgtacaaaccaggagtcgtttcacccgcgaaaaaataattcagctaagacactgcactggattaagatgaaaacgattgaagttgatgatgaactctacagctatattgccagccacactaagcatatcggcgagagcgcatccgacattttacggcgtatgttgaaattttccgccgcatcacagcctgctgctccggtgacgaaagaggttcgcgttgcgtcacctgctatcgtcgaagcgaagccggtcaaaacgattaaagacaaggttcgcgcaatgcgtgaacttctgctttcggatgaatacgcagagcaaaagcgagcggtcaatcgctttatgctgctgttgtctacactatattctcttgacgcccaggcgtttgccgaagcaacggaatcgttgcacggtcgtacacgcgtttactttgcggcagatgaacaaacgctgctgaaaaatggtaatcagaccaagccgaaacatgtgccaggcacgccgtattgggtgatcaccaacaccaacaccggccgtaaatgcagcatgatcgaacacatcatgcagtcgatgcaattcccggcggaattgattgagaaggtttgcggaactatctaacggctgaaattaatgaggtcatacccaaatggatagttcgtttacgcccattgaacaaatgctaaaatttcgcgccagccgccacgaagattttccttatcaggagatccttctgactcgtctttgcatgcacatgcaaagcaagctgctggagaaccgcaataaaatgctgaaggctcagggaattaacgagacgttgtttatggcgttgattacgctggagtctcaggaaaaccacagtattcagccttctgaattaagttgtgctcttggatcatcccgtaccaacgcgacgcgtattgccgatgaactggaaaaacgcggttggatcgaacgtcgtgaaagcgataacgatcgccgctgcctgcatctgcaattaacggaaaaaggtcacgagtttttgcgcgaggttttaccaccgcagcataactgcctgcatcaactctggtccgcgctcagcacaacagaaaaagatcagctcgagcaaatcacccgcaaattgctctcccgtctcgaccagatggaacaagacggtgtggttctcgaagcgatgagctaataatacaaaaattaggaggaatttcaacatgacaaatttatctgacatcattgaaaaagaaacaggaaaacaactagtgattcaagaatcaattctaatgttaccagaagaagtagaggaagtaattgggaataaaccagaaagtgatattttagttcatactgcttatgatgaaagtacagatgaaaatgtaatgctattaacttcagatgctccagaatataaaccttgggctttagtaattcaagacagtaatggagaaaataaaattaaaatgttataagtcgagattaagtaaaccggaatctgaagatggactctctgctgatgaaccgtagcgaattcctgtaccagttcaaaaacgttcgttgggcgaaaggtcgtcgtgaaacctacctgtgctacgttgttaaacgttgcgactctgcgacctctttctctcgtgacttcggttacctgcgtaacaaaaacggttgccacgttgaactgctgttcctgcgttacatctctgactgggacctggacccgggtcgttgctaccgtgttacctggttcatctcttggtctccgtgctctgactgcgcgcgtctggttgcggacttcctgcgtggtaacccgaacctgtctctgcgtatcttcaccgcgcgtctgtacttctgcgaagaccgtaaagcggaaccggaaggtctgcgtcgtctgcaccgtgcgggtgttcagatcgcgatcatgaccttcgaagactacttctactgctggaacaccttcgttgaaaaccacggccgtaccttcaaagcgtgggaaggtctgcacgaaaactctgttcgtctgtctcgtcagctgcgtcgtatcctgctgccgctgtacgaagttgacgacctgcgtgacgcgttccgtaccctgggtctgtaaacttaattaacggcactcctcagccaagtcaaaagcctccgaccggaggcttttgactacatgcccatggcgtttacgccccgccctgccactcatcgcagtactgttgtaattcattaagcattctgccgacatggaagccatcacaaacggcatgatgaacctgaatcgccagcggcatcagcaccttgtcgccttgcgtataatatttgcccatagtgaaaacgggggcgaagaagttgtccatattggccacgtttaaatcaaaactggtgaaactcacccagggattggctgagacgaaaaacatattctcaataaaccctttagggaaataggccaggttttcaccgtaacacgccacatcttgcgaatatatgtgtagaaactgccggaaatcgtcgtggtattcactccagagcgatgaaaacgtttcagtttgctcatggaaaacggtgtaacaagggtgaacactatcccatatcaccagctcaccgtctttcattgccatacggaactccggatgagcattcatcaggcgggcaagaatgtgaataaaggccggataaaacttgtgcttatttttctttacggtctttaaaaaggccgtaatatccagctgaacggtctggttataggtacattgagtaactgactgaaatgcctcaaaatgttctttacgatgccattgggatatatcaacggtggtatatccagtgatttttttctccattttagcttccttagctcctgaaaatctcgataactcaaaaaatacgcccggtagtgatcttatttcattatggtgaaagttggaacctcttacgtgccaagccaaataggccgt

SEQ ID NO: 114 - DNA, 6651 bp, Artificial Sequence
  Synthetic Polynucleotide
cactcggtcgctacgctccgggcgtgagactgcggcgggcgctgcggacacatacaaagttacccacagattccgtggataagcaggggactaacatgtgaggcaaaacagcagggccgcgccggtggcgtttttccataggctccgccctcctgccagagttcacataaacagacgcttttccggtgcatctgtgggagccgtgaggctcaaccatgaatctgacagtacgggcgaaacccgacaggacttaaagatccccaccgtttccggcgggtcgctccctcttgcgctctcctgttccgaccctgccgtttaccggatacctgttccgcctttctcccttacgggaagtgtggcgctttctcatagctcacacactggtatctcggctcggtgtaggtcgttcgctccaagctgggctgtaagcaagaactccccgttcagcccgactgctgcgccttatccggtaactgttcacttgagtccaacccggaaaagcacggtaaaacgccactggcagcagccattggtaactgggagttcgcagaggatttgtttagctaaacacgcggttgctcttgaagtgtgcgccaaagtccggctacactggaaggacagatttggttgctgtgctctgcgaaagccagttaccacggttaagcagttccccaactgacttaaccttcgatcaaaccacctccccaggtggttttttcgtttacagggcaaaagattacgcgcagaaaaaaaggatctcaagaagatcctttgatcttttctactgaaccgctctagatttcagtgcaatttatctcttcaaatgtagcacctgaagtcagcccaggaggaagaggacatccggtcaaataaaacgaaaggctcagtcgaaagactgggcctttcgttttagacttagggaccctttatgacaacttgacggctacatcattcactttttcttcacaaccggcacggaactcgctcgggctggccccggtgcattttttaaatacccgcgagaaatagagttgatcgtcaaaaccaacattgcgaccgacggtggcgataggcatccgggtggtgctcaaaagcagcttcgcctggctgatacgttggtcctcgcgccagcttaagacgctaatccctaactgctggcggaaaagatgtgacagacgcgacggcgacaagcaaacatgctgtgcgacgctggcgatatcaaaattgctgtctgccaggtgatcgctgatgtactgacaagcctcgcgtacccgattatccatcggtggatggagcgactcgttaatcgcttccatgcgccgcagtaacaattgctcaagcagatttatcgccagcagctccgaatagcgcccttccccttgcccggcgttaatgatttgcccaaacaggtcgctgaaatgcggctggtgcgcttcatccgggcgaaagaaccccgtattggcaaatattgacggccagttaagccattcatgccagtaggcgcgcggacgaaagtaaacccactggtgataccattcgcgagcctccggatgacgaccgtagtgatgaatctctcctggcgggaacagcaaaatatcacccggtcggcaaacaaattctcgtccctgatttttcaccaccccctgaccgcgaatggtgagattgagaatataacctttcattcccagcggtcggtcgataaaaaaatcgagataaccgttggcctcaatcggcgttaaacccgccaccagatgggcattaaacgagtatcccggcagcaggggatcattttgcgcttcagccatacttttcatactcccaccattcagagaagaaaccaattgtccatattgcatcagacattgccgtcactgcgtcttttactggctcttctcgctaacccaaccggtaaccccgcttattaaaagcattctgtaacaaagcgggaccaaagccatgacaaaaacgcgtaacaaaagtgtctataatcacggcagaaaagtccacattgattatttgcacggcgtcacactttgctatgccatagcatttttatccataagattagcggatcctacctgacgctttttatcgcaactctctactgtttctccatacccgtttttttggacgcgtacaactcaagtctgacataaatgaccgctatgagcactgcaattacacgccagatcgttctcgctaccgcaaccaccggtatgaaccagattggtgcgcactatgaaggccacaagatcattgagattggtgccgttgaagtggtgaaccgtcgcctgacgggcaataacttccatgtttatctcaaacccgatcggctggtggatccggaagcctttggcgtacatggtattgccgatgaatttttgctcgataagcccacgtttgccgaagtagccgatgagttcatggactatattcgcggcgcggagttggtgatccataacgcagcgttcgatatcggctttatggactacgagttttcgttgcttaagcgcgatattccgaagaccaatactttctgtaaggtcaccgatagccttgcggtggcgaggaaaatgtttcccggtaagcgcaacagcctcgatgcgttatgtgctcgctacgaaatagataacagtaaacgaacgctgcacggggcattactcgatgcccagatccttgcggaagtttatctggcgatgaccggtggtcaaacgtcgatggcttttgcgatggaaggagagacacaacagcaacaaggtgaagcaacaattcagcgcattgtacgtcaggcaagtaagttacgcgttgtttttgcgacagatgaagagattgcagctcatgaagcccgtctcgatctggtgcagaagaaaggcggaagttgcctctggcgagcataatttaatatcagtaaaccggacataacccatgaagaaaaatcgcgcttttttgaagtgggcagggggcaagtatcccctgcttgatgatattaaacggcatttgcccaagggcgaatgtctggttgagccttttgtaggtgccgggtcggtgtttctcaacaccgacttttctcgttatatccttgccgatatcaatagcgacctgatcagtctctataacattgtgaagatgcgtactgatgagtacgtacaggccgcacgcgagctgtttgttcccgaaacaaattgcgccgaggtttactatcagttccgcgaagagttcaacaaaagccaggatccgttccgtcgggcggtactgtttttatatttgaaccgctacggttacaacggcctgtgtcgttacaatctgcgcggtgagtttaacgtgccgttcggccgctacaaaaaaccctatttcccggaagcagagttgtatcacttcgctgaaaaagcgcagaatgcctttttctattgtgagtcttacgccgatagcatggcgcgcgcagatgatgcatccgtcgtctattgcgatccgccttatgcaccgctgtctgcgaccgccaactttacggcgtatcacacaaacagttttacgcttgaacaacaagcgcatctggcggagatcgccgaaggtctggttgagcgccatattccagtgctgatctccaatcacgatacgatgttaacgcgtgagtggtatcagcgcgcaaaattgcatgtcgtcaaagttcgacgcagtataagcagcaacggcggcacacgtaaaaaggtggacgaactgctggctttgtacaaaccaggagtcgtttcacccgcgaaaaaataattcagctaagacactgcactggattaagatgaaaacgattgaagttgatgatgaactctacagctatattgccagccacactaagcatatcggcgagagcgcatccgacattttacggcgtatgttgaaattttccgccgcatcacagcctgctgctccggtgacgaaagaggttcgcgttgcgtcacctgctatcgtcgaagcgaagccggtcaaaacgattaaagacaaggttcgcgcaatgcgtgaacttctgctttcggatgaatacgcagagcaaaagcgagcggtcaatcgctttatgctgctgttgtctacactatattctcttgacgcccaggcgtttgccgaagcaacggaatcgttgcacggtcgtacacgcgtttactttgcggcagatgaacaaacgctgctgaaaaatggtaatcagaccaagccgaaacatgtgccaggcacgccgtattgggtgatcaccaacaccaacaccggccgtaaatgcagcatgatcgaacacatcatgcagtcgatgcaattcccggcggaattgattgagaaggtttgcggaactatctaacggctgaaattaatgaggtcatacccaaatggatagttcgtttacgcccattgaacaaatgctaaaatttcgcgccagccgccacgaagattttccttatcaggagatccttctgactcgtctttgcatgcacatgcaaagcaagctgctggagaaccgcaataaaatgctgaaggctcagggaattaacgagacgttgtttatggcgttgattacgctggagtctcaggaaaaccacagtattcagccttctgaattaagttgtgctcttggatcatcccgtaccaacgcgacgcgtattgccgatgaactggaaaaacgcggttggatcgaacgtcgtgaaagcgataacgatcgccgctgcctgcatctgcaattaacggaaaaaggtcacgagtttttgcgcgaggttttaccaccgcagcataactgcctgcatcaactctggtccgcgctcagcacaacagaaaaagatcagctcgagcaaatcacccgcaaattgctctcccgtctcgaccagatggaacaagacggtgtggttctcgaagcgatgagctaataatacaaaaattaggaggaatttcaacatgacaaatttatctgacatcattgaaaaagaaacaggaaaacaactagtgattcaagaatcaattctaatgttaccagaagaagtagaggaagtaattgggaataaaccagaaagtgatattttagttcatactgcttatgatgaaagtacagatgaaaatgtaatgctattaacttcagatgctccagaatataaaccttgggctttagtaattcaagacagtaatggagaaaataaaattaaaatgttataagtcgagattaagtaaaccggaatctgaagatggactctctgctgatgaaccgtcgtgaattcctgtaccagttcaaaaacgttcgttgggcgaaaggtcgtcgtgaaacctacctgtgctacgttgttaaacgtcgtgactctgcgacctctttctctctggacttcggttacctgcgtaacaaaaacggttgccacgttgaactgctgttcctgcgttacatcaccgactgggacctggacccgggtcgttgctaccgtgttacctggttcatctcttggtctccgtgctacgactgcgcgcgtcacgttgcggacttcctgcgtggtaacccgaacatctctctgcgtatcttcaccgcgcgtctgtacttctgcgaagaccgtaaagcggaaccggaaggtctgcgtcgtctgcaccgtgcgggtgttcagatcgcgatcatgaccttcaaagactacttctactgctggaacaccttcgttgaaaaccacggccgtaccttcgaagcgtgggaaggtctgcacgaaaactctgttcgtctgtctcgtcagctgcgtcgtatcctgtaaccgctgtacgaagttgacgacctgcgtgacgcgttccgtaccctgggtctgtaaacttaattaacggcactcctcagccaagtcaaaagcctccgaccggaggcttttgactacatgcccatggcgtttacgccccgccctgccactcatcgcagtactgttgtaattcattaagcattctgccgacatggaagccatcacaaacggcatgatgaacctgaatcgccagcggcatcagcaccttgtcgccttgcgtataatatttgcccatagtgaaaacgggggcgaagaagttgtccatattggccacgtttaaatcaaaactggtgaaactcacccagggattggctgagacgaaaaacatattctcaataaaccctttagggaaataggccaggttttcaccgtaacacgccacatcttgcgaatatatgtgtagaaactgccggaaatcgtcgtggtattcactccagagcgatgaaaacgtttcagtttgctcatggaaaacggtgtaacaagggtgaacactatcccatatcaccagctcaccgtctttcattgccatacggaactccggatgagcattcatcaggcgggcaagaatgtgaataaaggccggataaaacttgtgcttatttttctttacggtctttaaaaaggccgtaatatccagctgaacggtctggttataggtacattgagtaactgactgaaatgcctcaaaatgttctttacgatgccattgggatatatcaacggtggtatatccagtgatttttttctccattttagcttccttagctcctgaaaatctcgataactcaaaaaatacgcccggtagtgatcttatttcattatggtgaaagttggaacctcttacgtgccaagccaaataggccgt

SEQ ID NO: 115 - DNA, 6665 bp, Artificial Sequence
  Synthetic Polynucleotide
cactcggtcgctacgctccgggcgtgagactgcggcgggcgctgcggacacatacaaagttacccacagattccgtggataagcaggggactaacatgtgaggcaaaacagcagggccgcgccggtggcgtttttccataggctccgccctcctgccagagttcacataaacagacgcttttccggtgcatctgtgggagccgtgaggctcaaccatgaatctgacagtacgggcgaaacccgacaggacttaaagatccccaccgtttccggcgggtcgctccctcttgcgctctcctgttccgaccctgccgtttaccggatacctgttccgcctttctcccttacgggaagtgtggcgctttctcatagctcacacactggtatctcggctcggtgtaggtcgttcgctccaagctgggctgtaagcaagaactccccgttcagcccgactgctgcgccttatccggtaactgttcacttgagtccaacccggaaaagcacggtaaaacgccactggcagcagccattggtaactgggagttcgcagaggatttgtttagctaaacacgcggttgctcttgaagtgtgcgccaaagtccggctacactggaaggacagatttggttgctgtgctctgcgaaagccagttaccacggttaagcagttccccaactgacttaaccttcgatcaaaccacctccccaggtggttttttcgtttacagggcaaaagattacgcgcagaaaaaaaggatctcaagaagatcctttgatcttttctactgaaccgctctagatttcagtgcaatttatctcttcaaatgtagcacctgaagtcagcccaggaggaagaggacatccggtcaaataaaacgaaaggctcagtcgaaagactgggcctttcgttttagacttagggaccctttatgacaacttgacggctacatcattcactttttcttcacaaccggcacggaactcgctcgggctggccccggtgcattttttaaatacccgcgagaaatagagttgatcgtcaaaaccaacattgcgaccgacggtggcgataggcatccgggtggtgctcaaaagcagcttcgcctggctgatacgttggtcctcgcgccagcttaagacgctaatccctaactgctggcggaaaagatgtgacagacgcgacggcgacaagcaaacatgctgtgcgacgctggcgatatcaaaattgctgtctgccaggtgatcgctgatgtactgacaagcctcgcgtacccgattatccatcggtggatggagcgactcgttaatcgcttccatgcgccgcagtaacaattgctcaagcagatttatcgccagcagctccgaatagcgcccttccccttgcccggcgttaatgatttgcccaaacaggtcgctgaaatgcggctggtgcgcttcatccgggcgaaagaaccccgtattggcaaatattgacggccagttaagccattcatgccagtaggcgcgcggacgaaagtaaacccactggtgataccattcgcgagcctccggatgacgaccgtagtgatgaatctctcctggcgggaacagcaaaatatcacccggtcggcaaacaaattctcgtccctgatttttcaccaccccctgaccgcgaatggtgagattgagaatataacctttcattcccagcggtcggtcgataaaaaaatcgagataaccgttggcctcaatcggcgttaaacccgccaccagatgggcattaaacgagtatcccggcagcaggggatcattttgcgcttcagccatacttttcatactcccaccattcagagaagaaaccaattgtccatattgcatcagacattgccgtcactgcgtcttttactggctcttctcgctaacccaaccggtaaccccgcttattaaaagcattctgtaacaaagcgggaccaaagccatgacaaaaacgcgtaacaaaagtgtctataatcacggcagaaaagtccacattgattatttgcacggcgtcacactttgctatgccatagcatttttatccataagattagcggatcctacctgacgctttttatcgcaactctctactgtttctccatacccgttttttgggctaacaggaggaattaaccatgagcactgcaattacacgccagatcgttctcgctaccgcaaccaccggtatgaaccagattggtgcgcactatgaaggccacaagatcattgagattggtgccgttgaagtggtgaaccgtcgcctgacgggcaataacttccatgtttatctcaaacccgatcggctggtggatccggaagcctttggcgtacatggtattgccgatgaatttttgctcgataagcccacgtttgccgaagtagccgatgagttcatggactatattcgcggcgcggagttggtgatccataacgcagcgttcgatatcggctttatggactacgagttttcgttgcttaagcgcgatattccgaagaccaatactttctgtaaggtcaccgatagccttgcggtggcgaggaaaatgtttcccggtaagcgcaacagcctcgatgcgttatgtgctcgctacgaaatagataacagtaaacgaacgctgcacggggcattactcgatgcccagatccttgcggaagtttatctggcgatgaccggtggtcaaacgtcgatggcttttgcgatggaaggagagacacaacagcaacaaggtgaagcaacaattcagcgcattgtacgtcaggcaagtaagttacgcgttgtttttgcgacagatgaagagattgcagctcatgaagcccgtctcgatctggtgcagaagaaaggcggaagttgcctctggcgagcataatttaatatcagtaaaccggacataacccatgaagaaaaatcgcgcttttttgaagtgggcagggggcaagtatcccctgcttgatgatattaaacggcatttgcccaagggcgaatgtctggttgagccttttgtaggtgccgggtcggtgtttctcaacaccgacttttctcgttatatccttgccgatatcaatagcgacctgatcagtctctataacattgtgaagatgcgtactgatgagtacgtacaggccgcacgcgagctgtttgttcccgaaacaaattgcgccgaggtttactatcagttccgcgaagagttcaacaaaagccaggatccgttccgtcgggcggtactgtttttatatttgaaccgctacggttacaacggcctgtgtcgttacaatctgcgcggtgagtttaacgtgccgttcggccgctacaaaaaaccctatttcccggaagcagagttgtatcacttcgctgaaaaagcgcagaatgcctttttctattgtgagtcttacgccgatagcatggcgcgcgcagatgatgcatccgtcgtctattgcgatccgccttatgcaccgctgtctgcgaccgccaactttacggcgtatcacacaaacagttttacgcttgaacaacaagcgcatctggcggagatcgccgaaggtctggttgagcgccatattccagtgctgatctccaatcacgatacgatgttaacgcgtgagtggtatcagcgcgcaaaattgcatgtcgtcaaagttcgacgcagtataagcagcaacggcggcacacgtaaaaaggtggacgaactgctggctttgtacaaaccaggagtcgtttcacccgcgaaaaaataattcagctaagacactgcactggattaagatgaaaacgattgaagttgatgatgaactctacagctatattgccagccacactaagcatatcggcgagagcgcatccgacattttacggcgtatgttgaaattttccgccgcatcacagcctgctgctccggtgacgaaagaggttcgcgttgcgtcacctgctatcgtcgaagcgaagccggtcaaaacgattaaagacaaggttcgcgcaatgcgtgaacttctgctttcggatgaatacgcagagcaaaagcgagcggtcaatcgctttatgctgctgttgtctacactatattctcttgacgcccaggcgtttgccgaagcaacggaatcgttgcacggtcgtacacgcgtttactttgcggcagatgaacaaacgctgctgaaaaatggtaatcagaccaagccgaaacatgtgccaggcacgccgtattgggtgatcaccaacaccaacaccggccgtaaatgcagcatgatcgaacacatcatgcagtcgatgcaattcccggcggaattgattgagaaggtttgcggaactatctaacggctgaaattaatgaggtcatacccaaatggatagttcgtttacgcccattgaacaaatgctaaaatttcgcgccagccgccacgaagattttccttatcaggagatccttctgactcgtctttgcatgcacatgcaaagcaagctgctggagaaccgcaataaaatgctgaaggctcagggaattaacgagacgttgtttatggcgttgattacgctggagtctcaggaaaaccacagtattcagccttctgaattaagttgtgctcttggatcatcccgtaccaacgcgacgcgtattgccgatgaactggaaaaacgcggttggatcgaacgtcgtgaaagcgataacgatcgccgctgcctgcatctgcaattaacggaaaaaggtcacgagtttttgcgcgaggttttaccaccgcagcataactgcctgcatcaactctggtccgcgctcagcacaacagaaaaagatcagctcgagcaaatcacccgcaaattgctctcccgtctcgaccagatggaacaagacggtgtggttctcgaagcgatgagctaataatacaaaaattaggaggaatttcaacatgacaaatttatctgacatcattgaaaaagaaacaggaaaacaactagtgattcaagaatcaattctaatgttaccagaagaagtagaggaagtaattgggaataaaccagaaagtgatattttagttcatactgcttatgatgaaagtacagatgaaaatgtaatgctattaacttcagatgctccagaatataaaccttgggctttagtaattcaagacagtaatggagaaaataaaattaaaatgttataagtcgagattaagtaaaccggaatctgaagatgaccgacgcggaatacgttcgtatccacgaaaaactggacatctacaccttcaaaaaacagttcttcaacaacaaaaaatctgtttctcaccgttgctacgttctgttcgaactgaaacgtcgtggtgaacgtcgtgcgtgcttctggggttacgcggttaacaaaccgcagtctggtaccgaacgtggtatccacgcggaaatcttctctatccgtaaagttgaagaatacctgcgtgacaacccgggtcagttcaccatcaactggtactcttcttggtctccgtgcgcggactgcgcggaaaaaatcctggaatggtacaaccaggaactgcgtggtaacggtcacaccctgaaaatctgggcgtgcaaactgtactacgaaaaaaacgcgcgtaaccagatcggtctgtggaacctgcgtgacaacggtgttggtctgaacgttatggtttctgaacactaccagtgctgccgtaaaatcttcatccagtcttctcacaaccagctgaacgaaaaccgttggctggaaaaaaccctgaaacgtgcggaaaaacgtcgttctgaactgtctatcatgatccaggttaaaatcctgcacaccaccaaatctccggcggtttaaacttaattaacggcactcctcagccaagtcaaaagcctccggtcggaggcttttgactacatgcccatggcgtttacgccccgccctgccactcatcgcagtactgttgtaattcattaagcattctgccgacatggaagccatcacaaacggcatgatgaacctgaatcgccagcggcatcagcaccttgtcgccttgcgtataatatttgcccatagtgaaaacgggggcgaagaagttgtccatattggccacgtttaaatcaaaactggtgaaactcacccagggattggctgagacgaaaaacatattctcaataaaccctttagggaaataggccaggttttcaccgtaacacgccacatcttgcgaatatatgtgtagaaactgccggaaatcgtcgtggtattcactccagagcgatgaaaacgtttcagtttgctcatggaaaacggtgtaacaagggtgaacactatcccatatcaccagctcaccgtctttcattgccatacggaactccggatgagcattcatcaggcgggcaagaatgtgaataaaggccggataaaacttgtgcttatttttctttacggtctttaaaaaggccgtaatatccagctgaacggtctggttataggtacattgagtaactgactgaaatgcctcaaaatgttctttacgatgccattgggatatatcaacggtggtatatccagtgatttttttctccattttagcttccttagctcctgaaaatctcgataactcaaaaaatacgcccggtagtgatcttatttcattatggtgaaagttggaacctcttacgtgccaagccaaataggccgt

SEQ ID NO: 116 - DNA, 6681 bp, Artificial Sequence
  Synthetic Polynucleotide
cactcggtcgctacgctccgggcgtgagactgcggcgggcgctgcggacacatacaaagttacccacagattccgtggataagcaggggactaacatgtgaggcaaaacagcagggccgcgccggtggcgtttttccataggctccgccctcctgccagagttcacataaacagacgcttttccggtgcatctgtgggagccgtgaggctcaaccatgaatctgacagtacgggcgaaacccgacaggacttaaagatccccaccgtttccggcgggtcgctccctcttgcgctctcctgttccgaccctgccgtttaccggatacctgttccgcctttctcccttacgggaagtgtggcgctttctcatagctcacacactggtatctcggctcggtgtaggtcgttcgctccaagctgggctgtaagcaagaactccccgttcagcccgactgctgcgccttatccggtaactgttcacttgagtccaacccggaaaagcacggtaaaacgccactggcagcagccattggtaactgggagttcgcagaggatttgtttagctaaacacgcggttgctcttgaagtgtgcgccaaagtccggctacactggaaggacagatttggttgctgtgctctgcgaaagccagttaccacggttaagcagttccccaactgacttaaccttcgatcaaaccacctccccaggtggttttttcgtttacagggcaaaagattacgcgcagaaaaaaaggatctcaagaagatcctttgatcttttctactgaaccgctctagatttcagtgcaatttatctcttcaaatgtagcacctgaagtcagcccaggaggaagaggacatccggtcaaataaaacgaaaggctcagtcgaaagactgggcctttcgttttagacttagggaccctttatgacaacttgacggctacatcattcactttttcttcacaaccggcacggaactcgctcgggctggccccggtgcattttttaaatacccgcgagaaatagagttgatcgtcaaaaccaacattgcgaccgacggtggcgataggcatccgggtggtgctcaaaagcagcttcgcctggctgatacgttggtcctcgcgccagcttaagacgctaatccctaactgctggcggaaaagatgtgacagacgcgacggcgacaagcaaacatgctgtgcgacgctggcgatatcaaaattgctgtctgccaggtgatcgctgatgtactgacaagcctcgcgtacccgattatccatcggtggatggagcgactcgttaatcgcttccatgcgccgcagtaacaattgctcaagcagatttatcgccagcagctccgaatagcgcccttccccttgcccggcgttaatgatttgcccaaacaggtcgctgaaatgcggctggtgcgcttcatccgggcgaaagaaccccgtattggcaaatattgacggccagttaagccattcatgccagtaggcgcgcggacgaaagtaaacccactggtgataccattcgcgagcctccggatgacgaccgtagtgatgaatctctcctggcgggaacagcaaaatatcacccggtcggcaaacaaattctcgtccctgatttttcaccaccccctgaccgcgaatggtgagattgagaatataacctttcattcccagcggtcggtcgataaaaaaatcgagataaccgttggcctcaatcggcgttaaacccgccaccagatgggcattaaacgagtatcccggcagcaggggatcattttgcgcttcagccatacttttcatactcccaccattcagagaagaaaccaattgtccatattgcatcagacattgccgtcactgcgtcttttactggctcttctcgctaacccaaccggtaaccccgcttattaaaagcattctgtaacaaagcgggaccaaagccatgacaaaaacgcgtaacaaaagtgtctataatcacggcagaaaagtccacattgattatttgcacggcgtcacactttgctatgccatagcatttttatccataagattagcggatcctacctgacgctttttatcgcaactctctactgtttctccatacccgtttttttggacgcgtacaactcaagtctgacataaatgaccgctatgagcactgcaattacacgccagatcgttctcgctaccgcaaccaccggtatgaaccagattggtgcgcactatgaaggccacaagatcattgagattggtgccgttgaagtggtgaaccgtcgcctgacgggcaataacttccatgtttatctcaaacccgatcggctggtggatccggaagcctttggcgtacatggtattgccgatgaatttttgctcgataagcccacgtttgccgaagtagccgatgagttcatggactatattcgcggcgcggagttggtgatccataacgcagcgttcgatatcggctttatggactacgagttttcgttgcttaagcgcgatattccgaagaccaatactttctgtaaggtcaccgatagccttgcggtggcgaggaaaatgtttcccggtaagcgcaacagcctcgatgcgttatgtgctcgctacgaaatagataacagtaaacgaacgctgcacggggcattactcgatgcccagatccttgcggaagtttatctggcgatgaccggtggtcaaacgtcgatggcttttgcgatggaaggagagacacaacagcaacaaggtgaagcaacaattcagcgcattgtacgtcaggcaagtaagttacgcgttgtttttgcgacagatgaagagattgcagctcatgaagcccgtctcgatctggtgcagaagaaaggcggaagttgcctctggcgagcataatttaatatcagtaaaggaggcataacccatgaagaaaaatcgcgcttttttgaagtgggcagggggcaagtatcccctgcttgatgatattaaacggcatttgcccaagggcgaatgtctggttgagccttttgtaggtgccgggtcggtgtttctcaacaccgacttttctcgttatatccttgccgatatcaatagcgacctgatcagtctctataacattgtgaagatgcgtactgatgagtacgtacaggccgcacgcgagctgtttgttcccgaaacaaattgcgccgaggtttactatcagttccgcgaagagttcaacaaaagccaggatccgttccgtcgggcggtactgtttttatatttgaaccgctacggttacaacggcctgtgtcgttacaatctgcgcggtgagtttaacgtgccgttcggccgctacaaaaaaccctatttcccggaagcagagttgtatcacttcgctgaaaaagcgcagaatgcctttttctattgtgagtcttacgccgatagcatggcgcgcgcagatgatgcatccgtcgtctattgcgatccgccttatgcaccgctgtctgcgaccgccaactttacggcgtatcacacaaacagttttacgcttgaacaacaagcgcatctggcggagatcgccgaaggtctggttgagcgccatattccagtgctgatctccaatcacgatacgatgttaacgcgtgagtggtatcagcgcgcaaaattgcatgtcgtcaaagttcgacgcagtataagcagcaacggcggcacacgtaaaaaggtggacgaactgctggctttgtacaaaccaggagtcgtttcacccgcgaaaaaataattcagctaagacactgcactggattaagatgaaaacgattgaagttgatgatgaactctacagctatattgccagccacactaagcatatcggcgagagcgcatccgacattttacggcgtatgttgaaattttccgccgcatcacagcctgctgctccggtgacgaaagaggttcgcgttgcgtcacctgctatcgtcgaagcgaagccggtcaaaacgattaaagacaaggttcgcgcaatgcgtgaacttctgctttcggatgaatacgcagagcaaaagcgagcggtcaatcgctttatgctgctgttgtctacactatattctcttgacgcccaggcgtttgccgaagcaacggaatcgttgcacggtcgtacacgcgtttactttgcggcagatgaacaaacgctgctgaaaaatggtaatcagaccaagccgaaacatgtgccaggcacgccgtattgggtgatcaccaacaccaacaccggccgtaaatgcagcatgatcgaacacatcatgcagtcgatgcaattcccggcggaattgattgagaaggtttgcggaactatctaacggctgaaattaatgaggtcatacccaaatggatagttcgtttacgcccattgaacaaatgctaaaatttcgcgccagccgccacgaagattttccttatcaggagatccttctgactcgtctttgcatgcacatgcaaagcaagctgctggagaaccgcaataaaatgctgaaggctcagggaattaacgagacgttgtttatggcgttgattacgctggagtctcaggaaaaccacagtattcagccttctgaattaagttgtgctcttggatcatcccgtaccaacgcgacgcgtattgccgatgaactggaaaaacgcggttggatcgaacgtcgtgaaagcgataacgatcgccgctgcctgcatctgcaattaacggaaaaaggtcacgagtttttgcgcgaggttttaccaccgcagcataactgcctgcatcaactctggtccgcgctcagcacaacagaaaaagatcagctcgagcaaatcacccgcaaattgctctcccgtctcgaccagatggaacaagacggtgtggttctcgaagcgatgagctaataatacaaaaattaggaggaatttcaacatgacaaatttatctgacatcattgaaaaagaaacaggaaaacaactagtgattcaagaatcaattctaatgttaccagaagaagtagaggaagtaattgggaataaaccagaaagtgatattttagttcatactgcttatgatgaaagtacagatgaaaatgtaatgctattaacttcagatgctccagaatataaaccttgggctttagtaattcaagacagtaatggagaaaataaaattaaaatgttataagtcgagattaagtaaaccggaatctgaagatgaccgacgcggaatacgttcgtatccacgaaaaactggacatctacaccttcaaaaaacagttcttcaacaacaaaaaatctgtttctcaccgttgctacgttctgttcgaactgaaacgtcgtggtgaacgtcgtgcgtgcttctggggttacgcggttaacaaaccgcagtctggtaccgaacgtggtatccacgcggaaatcttctctatccgtaaagttgaagaatacctgcgtgacaacccgggtcagttcaccatcaactggtactcttcttggtctccgtgcgcggactgcgcggaaaaaatcctggaatggtacaaccaggaactgcgtggtaacggtcacaccctgaaaatctgggcgtgcaaactgtactacgaaaaaaacgcgcgtaaccagatcggtctgtggaacctgcgtgacaacggtgttggtctgaacgttatggtttctgaacactaccagtgctgccgtaaaatcttcatccagtcttctcacaaccagctgaacgaaaaccgttggctggaaaaaaccctgaaacgtgcggaaaaacgtcgttctgaactgtctatcatgatccaggttaaaatcctgcacaccaccaaatctccggcggtttaaacttaattaacggcactcctcagccaagtcaaaagcctccggtcggaggcttttgactacatgcccatggcgtttacgccccgccctgccactcatcgcagtactgttgtaattcattaagcattctgccgacatggaagccatcacaaacggcatgatgaacctgaatcgccagcggcatcagcaccttgtcgccttgcgtataatatttgcccatagtgaaaacgggggcgaagaagttgtccatattggccacgtttaaatcaaaactggtgaaactcacccagggattggctgagacgaaaaacatattctcaataaaccctttagggaaataggccaggttttcaccgtaacacgccacatcttgcgaatatatgtgtagaaactgccggaaatcgtcgtggtattcactccagagcgatgaaaacgtttcagtttgctcatggaaaacggtgtaacaagggtgaacactatcccatatcaccagctcaccgtctttcattgccatacggaactccggatgagcattcatcaggcgggcaagaatgtgaataaaggccggataaaacttgtgcttatttttctttacggtctttaaaaaggccgtaatatccagctgaacggtctggttataggtacattgagtaactgactgaaatgcctcaaaatgttctttacgatgccattgggatatatcaacggtggtatatccagtgatttttttctccattttagcttccttagctcctgaaaatctcgataactcaaaaaatacgcccggtagtgatcttatttcattatggtgaaagttggaacctcttacgtgccaagccaaataggccgt

SEQ ID NO: 117 - DNA, 6681 bp, Artificial Sequence
  Synthetic Polynucleotide
cactcggtcgctacgctccgggcgtgagactgcggcgggcgctgcggacacatacaaagttacccacagattccgtggataagcaggggactaacatgtgaggcaaaacagcagggccgcgccggtggcgtttttccataggctccgccctcctgccagagttcacataaacagacgcttttccggtgcatctgtgggagccgtgaggctcaaccatgaatctgacagtacgggcgaaacccgacaggacttaaagatccccaccgtttccggcgggtcgctccctcttgcgctctcctgttccgaccctgccgtttaccggatacctgttccgcctttctcccttacgggaagtgtggcgctttctcatagctcacacactggtatctcggctcggtgtaggtcgttcgctccaagctgggctgtaagcaagaactccccgttcagcccgactgctgcgccttatccggtaactgttcacttgagtccaacccggaaaagcacggtaaaacgccactggcagcagccattggtaactgggagttcgcagaggatttgtttagctaaacacgcggttgctcttgaagtgtgcgccaaagtccggctacactggaaggacagatttggttgctgtgctctgcgaaagccagttaccacggttaagcagttccccaactgacttaaccttcgatcaaaccacctccccaggtggttttttcgtttacagggcaaaagattacgcgcagaaaaaaaggatctcaagaagatcctttgatcttttctactgaaccgctctagatttcagtgcaatttatctcttcaaatgtagcacctgaagtcagcccaggaggaagaggacatccggtcaaataaaacgaaaggctcagtcgaaagactgggcctttcgttttagacttagggaccctttatgacaacttgacggctacatcattcactttttcttcacaaccggcacggaactcgctcgggctggccccggtgcattttttaaatacccgcgagaaatagagttgatcgtcaaaaccaacattgcgaccgacggtggcgataggcatccgggtggtgctcaaaagcagcttcgcctggctgatacgttggtcctcgcgccagcttaagacgctaatccctaactgctggcggaaaagatgtgacagacgcgacggcgacaagcaaacatgctgtgcgacgctggcgatatcaaaattgctgtctgccaggtgatcgctgatgtactgacaagcctcgcgtacccgattatccatcggtggatggagcgactcgttaatcgcttccatgcgccgcagtaacaattgctcaagcagatttatcgccagcagctccgaatagcgcccttccccttgcccggcgttaatgatttgcccaaacaggtcgctgaaatgcggctggtgcgcttcatccgggcgaaagaaccccgtattggcaaatattgacggccagttaagccattcatgccagtaggcgcgcggacgaaagtaaacccactggtgataccattcgcgagcctccggatgacgaccgtagtgatgaatctctcctggcgggaacagcaaaatatcacccggtcggcaaacaaattctcgtccctgatttttcaccaccccctgaccgcgaatggtgagattgagaatataacctttcattcccagcggtcggtcgataaaaaaatcgagataaccgttggcctcaatcggcgttaaacccgccaccagatgggcattaaacgagtatcccggcagcaggggatcattttgcgcttcagccatacttttcatactcccaccattcagagaagaaaccaattgtccatattgcatcagacattgccgtcactgcgtcttttactggctcttctcgctaacccaaccggtaaccccgcttattaaaagcattctgtaacaaagcgggaccaaagccatgacaaaaacgcgtaacaaaagtgtctataatcacggcagaaaagtccacattgattatttgcacggcgtcacactttgctatgccatagcatttttatccataagattagcggatcctacctgacgctttttatcgcaactctctactgtttctccatacccgtttttttggacgcgtacaactcaagtctgacataaatgaccgctatgagcactgcaattacacgccagatcgttctcgctaccgcaaccaccggtatgaaccagattggtgcgcactatgaaggccacaagatcattgagattggtgccgttgaagtggtgaaccgtcgcctgacgggcaataacttccatgtttatctcaaacccgatcggctggtggatccggaagcctttggcgtacatggtattgccgatgaatttttgctcgataagcccacgtttgccgaagtagccgatgagttcatggactatattcgcggcgcggagttggtgatccataacgcagcgttcgatatcggctttatggactacgagttttcgttgcttaagcgcgatattccgaagaccaatactttctgtaaggtcaccgatagccttgcggtggcgaggaaaatgtttcccggtaagcgcaacagcctcgatgcgttatgtgctcgctacgaaatagataacagtaaacgaacgctgcacggggcattactcgatgcccagatccttgcggaagtttatctggcgatgaccggtggtcaaacgtcgatggcttttgcgatggaaggagagacacaacagcaacaaggtgaagcaacaattcagcgcattgtacgtcaggcaagtaagttacgcgttgtttttgcgacagatgaagagattgcagctcatgaagcccgtctcgatctggtgcagaagaaaggcggaagttgcctctggcgagcataatttaatatcagtaaaccggacataacccatgaagaaaaatcgcgcttttttgaagtgggcagggggcaagtatcccctgcttgatgatattaaacggcatttgcccaagggcgaatgtctggttgagccttttgtaggtgccgggtcggtgtttctcaacaccgacttttctcgttatatccttgccgatatcaatagcgacctgatcagtctctataacattgtgaagatgcgtactgatgagtacgtacaggccgcacgcgagctgtttgttcccgaaacaaattgcgccgaggtttactatcagttccgcgaagagttcaacaaaagccaggatccgttccgtcgggcggtactgtttttatatttgaaccgctacggttacaacggcctgtgtcgttacaatctgcgcggtgagtttaacgtgccgttcggccgctacaaaaaaccctatttcccggaagcagagttgtatcacttcgctgaaaaagcgcagaatgcctttttctattgtgagtcttacgccgatagcatggcgcgcgcagatgatgcatccgtcgtctattgcgatccgccttatgcaccgctgtctgcgaccgccaactttacggcgtatcacacaaacagttttacgcttgaacaacaagcgcatctggcggagatcgccgaaggtctggttgagcgccatattccagtgctgatctccaatcacgatacgatgttaacgcgtgagtggtatcagcgcgcaaaattgcatgtcgtcaaagttcgacgcagtataagcagcaacggcggcacacgtaaaaaggtggacgaactgctggctttgtacaaaccaggagtcgtttcacccgcgaaaaaataattcagctaagacactgcactggattaagatgaaaacgattgaagttgatgatgaactctacagctatattgccagccacactaagcatatcggcgagagcgcatccgacattttacggcgtatgttgaaattttccgccgcatcacagcctgctgctccggtgacgaaagaggttcgcgttgcgtcacctgctatcgtcgaagcgaagccggtcaaaacgattaaagacaaggttcgcgcaatgcgtgaacttctgctttcggatgaatacgcagagcaaaagcgagcggtcaatcgctttatgctgctgttgtctacactatattctcttgacgcccaggcgtttgccgaagcaacggaatcgttgcacggtcgtacacgcgtttactttgcggcagatgaacaaacgctgctgaaaaatggtaatcagaccaagccgaaacatgtgccaggcacgccgtattgggtgatcaccaacaccaacaccggccgtaaatgcagcatgatcgaacacatcatgcagtcgatgcaattcccggcggaattgattgagaaggtttgcggaactatctaacggctgaaattaaaaggaggatacccaaatggatagttcgtttacgcccattgaacaaatgctaaaatttcgcgccagccgccacgaagattttccttatcaggagatccttctgactcgtctttgcatgcacatgcaaagcaagctgctggagaaccgcaataaaatgctgaaggctcagggaattaacgagacgttgtttatggcgttgattacgctggagtctcaggaaaaccacagtattcagccttctgaattaagttgtgctcttggatcatcccgtaccaacgcgacgcgtattgccgatgaactggaaaaacgcggttggatcgaacgtcgtgaaagcgataacgatcgccgctgcctgcatctgcaattaacggaaaaaggtcacgagtttttgcgcgaggttttaccaccgcagcataactgcctgcatcaactctggtccgcgctcagcacaacagaaaaagatcagctcgagcaaatcacccgcaaattgctctcccgtctcgaccagatggaacaagacggtgtggttctcgaagcgatgagctaataatacaaaaattaggaggaatttcaacatgacaaatttatctgacatcattgaaaaagaaacaggaaaacaactagtgattcaagaatcaattctaatgttaccagaagaagtagaggaagtaattgggaataaaccagaaagtgatattttagttcatactgcttatgatgaaagtacagatgaaaatgtaatgctattaacttcagatgctccagaatataaaccttgggctttagtaattcaagacagtaatggagaaaataaaattaaaatgttataagtcgagattaagtaaaccggaatctgaagatgaccgacgcggaatacgttcgtatccacgaaaaactggacatctacaccttcaaaaaacagttcttcaacaacaaaaaatctgtttctcaccgttgctacgttctgttcgaactgaaacgtcgtggtgaacgtcgtgcgtgcttctggggttacgcggttaacaaaccgcagtctggtaccgaacgtggtatccacgcggaaatcttctctatccgtaaagttgaagaatacctgcgtgacaacccgggtcagttcaccatcaactggtactcttcttggtctccgtgcgcggactgcgcggaaaaaatcctggaatggtacaaccaggaactgcgtggtaacggtcacaccctgaaaatctgggcgtgcaaactgtactacgaaaaaaacgcgcgtaaccagatcggtctgtggaacctgcgtgacaacggtgttggtctgaacgttatggtttctgaacactaccagtgctgccgtaaaatcttcatccagtcttctcacaaccagctgaacgaaaaccgttggctggaaaaaaccctgaaacgtgcggaaaaacgtcgttctgaactgtctatcatgatccaggttaaaatcctgcacaccaccaaatctccggcggtttaaacttaattaacggcactcctcagccaagtcaaaagcctccggtcggaggcttttgactacatgcccatggcgtttacgccccgccctgccactcatcgcagtactgttgtaattcattaagcattctgccgacatggaagccatcacaaacggcatgatgaacctgaatcgccagcggcatcagcaccttgtcgccttgcgtataatatttgcccatagtgaaaacgggggcgaagaagttgtccatattggccacgtttaaatcaaaactggtgaaactcacccagggattggctgagacgaaaaacatattctcaataaaccctttagggaaataggccaggttttcaccgtaacacgccacatcttgcgaatatatgtgtagaaactgccggaaatcgtcgtggtattcactccagagcgatgaaaacgtttcagtttgctcatggaaaacggtgtaacaagggtgaacactatcccatatcaccagctcaccgtctttcattgccatacggaactccggatgagcattcatcaggcgggcaagaatgtgaataaaggccggataaaacttgtgcttatttttctttacggtctttaaaaaggccgtaatatccagctgaacggtctggttataggtacattgagtaactgactgaaatgcctcaaaatgttctttacgatgccattgggatatatcaacggtggtatatccagtgatttttttctccattttagcttccttagctcctgaaaatctcgataactcaaaaaatacgcccggtagtgatcttatttcattatggtgaaagttggaacctcttacgtgccaagccaaataggccgt

SEQ ID NO: 118 - DNA, 6681 bp, Artificial Sequence
  Synthetic Polynucleotide
cactcggtcgctacgctccgggcgtgagactgcggcgggcgctgcggacacatacaaagttacccacagattccgtggataagcaggggactaacatgtgaggcaaaacagcagggccgcgccggtggcgtttttccataggctccgccctcctgccagagttcacataaacagacgcttttccggtgcatctgtgggagccgtgaggctcaaccatgaatctgacagtacgggcgaaacccgacaggacttaaagatccccaccgtttccggcgggtcgctccctcttgcgctctcctgttccgaccctgccgtttaccggatacctgttccgcctttctcccttacgggaagtgtggcgctttctcatagctcacacactggtatctcggctcggtgtaggtcgttcgctccaagctgggctgtaagcaagaactccccgttcagcccgactgctgcgccttatccggtaactgttcacttgagtccaacccggaaaagcacggtaaaacgccactggcagcagccattggtaactgggagttcgcagaggatttgtttagctaaacacgcggttgctcttgaagtgtgcgccaaagtccggctacactggaaggacagatttggttgctgtgctctgcgaaagccagttaccacggttaagcagttccccaactgacttaaccttcgatcaaaccacctccccaggtggttttttcgtttacagggcaaaagattacgcgcagaaaaaaaggatctcaagaagatcctttgatcttttctactgaaccgctctagatttcagtgcaatttatctcttcaaatgtagcacctgaagtcagcccaggaggaagaggacatccggtcaaataaaacgaaaggctcagtcgaaagactgggcctttcgttttagacttagggaccctttatgacaacttgacggctacatcattcactttttcttcacaaccggcacggaactcgctcgggctggccccggtgcattttttaaatacccgcgagaaatagagttgatcgtcaaaaccaacattgcgaccgacggtggcgataggcatccgggtggtgctcaaaagcagcttcgcctggctgatacgttggtcctcgcgccagcttaagacgctaatccctaactgctggcggaaaagatgtgacagacgcgacggcgacaagcaaacatgctgtgcgacgctggcgatatcaaaattgctgtctgccaggtgatcgctgatgtactgacaagcctcgcgtacccgattatccatcggtggatggagcgactcgttaatcgcttccatgcgccgcagtaacaattgctcaagcagatttatcgccagcagctccgaatagcgcccttccccttgcccggcgttaatgatttgcccaaacaggtcgctgaaatgcggctggtgcgcttcatccgggcgaaagaaccccgtattggcaaatattgacggccagttaagccattcatgccagtaggcgcgcggacgaaagtaaacccactggtgataccattcgcgagcctccggatgacgaccgtagtgatgaatctctcctggcgggaacagcaaaatatcacccggtcggcaaacaaattctcgtccctgatttttcaccaccccctgaccgcgaatggtgagattgagaatataacctttcattcccagcggtcggtcgataaaaaaatcgagataaccgttggcctcaatcggcgttaaacccgccaccagatgggcattaaacgagtatcccggcagcaggggatcattttgcgcttcagccatacttttcatactcccaccattcagagaagaaaccaattgtccatattgcatcagacattgccgtcactgcgtcttttactggctcttctcgctaacccaaccggtaaccccgcttattaaaagcattctgtaacaaagcgggaccaaagccatgacaaaaacgcgtaacaaaagtgtctataatcacggcagaaaagtccacattgattatttgcacggcgtcacactttgctatgccatagcatttttatccataagattagcggatcctacctgacgctttttatcgcaactctctactgtttctccatacccgtttttttggacgcgtacaactcaagtctgacataaatgaccgctatgagcactgcaattacacgccagatcgttctcgctaccgcaaccaccggtatgaaccagattggtgcgcactatgaaggccacaagatcattgagattggtgccgttgaagtggtgaaccgtcgcctgacgggcaataacttccatgtttatctcaaacccgatcggctggtggatccggaagcctttggcgtacatggtattgccgatgaatttttgctcgataagcccacgtttgccgaagtagccgatgagttcatggactatattcgcggcgcggagttggtgatccataacgcagcgttcgatatcggctttatggactacgagttttcgttgcttaagcgcgatattccgaagaccaatactttctgtaaggtcaccgatagccttgcggtggcgaggaaaatgtttcccggtaagcgcaacagcctcgatgcgttatgtgctcgctacgaaatagataacagtaaacgaacgctgcacggggcattactcgatgcccagatccttgcggaagtttatctggcgatgaccggtggtcaaacgtcgatggcttttgcgatggaaggagagacacaacagcaacaaggtgaagcaacaattcagcgcattgtacgtcaggcaagtaagttacgcgttgtttttgcgacagatgaagagattgcagctcatgaagcccgtctcgatctggtgcagaagaaaggcggaagttgcctctggcgagcataatttaatatcagtaaaccggacataacccatgaagaaaaatcgcgcttttttgaagtgggcagggggcaagtatcccctgcttgatgatattaaacggcatttgcccaagggcgaatgtctggttgagccttttgtaggtgccgggtcggtgtttctcaacaccgacttttctcgttatatccttgccgatatcaatagcgacctgatcagtctctataacattgtgaagatgcgtactgatgagtacgtacaggccgcacgcgagctgtttgttcccgaaacaaattgcgccgaggtttactatcagttccgcgaagagttcaacaaaagccaggatccgttccgtcgggcggtactgtttttatatttgaaccgctacggttacaacggcctgtgtcgttacaatctgcgcggtgagtttaacgtgccgttcggccgctacaaaaaaccctatttcccggaagcagagttgtatcacttcgctgaaaaagcgcagaatgcctttttctattgtgagtcttacgccgatagcatggcgcgcgcagatgatgcatccgtcgtctattgcgatccgccttatgcaccgctgtctgcgaccgccaactttacggcgtatcacacaaacagttttacgcttgaacaacaagcgcatctggcggagatcgccgaaggtctggttgagcgccatattccagtgctgatctccaatcacgatacgatgttaacgcgtgagtggtatcagcgcgcaaaattgcatgtcgtcaaagttcgacgcagtataagcagcaacggcggcacacgtaaaaaggtggacgaactgctggctttgtacaaaccaggagtcgtttcacccgcgaaaaaataattcagctaagacactgcactggattaagatgaaaacgattgaagttgatgatgaactctacagctatattgccagccacactaagcatatcggcgagagcgcatccgacattttacggcgtatgttgaaattttccgccgcatcacagcctgctgctccggtgacgaaagaggttcgcgttgcgtcacctgctatcgtcgaagcgaagccggtcaaaacgattaaagacaaggttcgcgcaatgcgtgaacttctgctttcggatgaatacgcagagcaaaagcgagcggtcaatcgctttatgctgctgttgtctacactatattctcttgacgcccaggcgtttgccgaagcaacggaatcgttgcacggtcgtacacgcgtttactttgcggcagatgaacaaacgctgctgaaaaatggtaatcagaccaagccgaaacatgtgccaggcacgccgtattgggtgatcaccaacaccaacaccggccgtaaatgcagcatgatcgaacacatcatgcagtcgatgcaattcccggcggaattgattgagaaggtttgcggaactatctaacggctgaaattaatgaggtcatacccaaatggatagttcgtttacgcccattgaacaaatgctaaaatttcgcgccagccgccacgaagattttccttatcaggagatccttctgactcgtctttgcatgcacatgcaaagcaagctgctggagaaccgcaataaaatgctgaaggctcagggaattaacgagacgttgtttatggcgttgattacgctggagtctcaggaaaaccacagtattcagccttctgaattaagttgtgctcttggatcatcccgtaccaacgcgacgcgtattgccgatgaactggaaaaacgcggttggatcgaacgtcgtgaaagcgataacgatcgccgctgcctgcatctgcaattaacggaaaaaggtcacgagtttttgcgcgaggttttaccaccgcagcataactgcctgcatcaactctggtccgcgctcagcacaacagaaaaagatcagctcgagcaaatcacccgcaaattgctctcccgtctcgaccagatggaacaagacggtgtggttctcgaagcgatgagctaataatacaaaaattaggaggaatttcaacatgacaaatttatctgacatcattgaaaaagaaacaggaaaacaactagtgattcaagaatcaattctaatgttaccagaagaagtagaggaagtaattgggaataaaccagaaagtgatattttagttcatactgcttatgatgaaagtacagatgaaaatgtaatgctattaacttcagatgctccagaatataaaccttgggctttagtaattcaagacagtaatggagaaaataaaattaaaatgttataagtcgagattaagtaaaggaggatctgaagatgaccgacgcggaatacgttcgtatccacgaaaaactggacatctacaccttcaaaaaacagttcttcaacaacaaaaaatctgtttctcaccgttgctacgttctgttcgaactgaaacgtcgtggtgaacgtcgtgcgtgcttctggggttacgcggttaacaaaccgcagtctggtaccgaacgtggtatccacgcggaaatcttctctatccgtaaagttgaagaatacctgcgtgacaacccgggtcagttcaccatcaactggtactcttcttggtctccgtgcgcggactgcgcggaaaaaatcctggaatggtacaaccaggaactgcgtggtaacggtcacaccctgaaaatctgggcgtgcaaactgtactacgaaaaaaacgcgcgtaaccagatcggtctgtggaacctgcgtgacaacggtgttggtctgaacgttatggtttctgaacactaccagtgctgccgtaaaatcttcatccagtcttctcacaaccagctgaacgaaaaccgttggctggaaaaaaccctgaaacgtgcggaaaaacgtcgttctgaactgtctatcatgatccaggttaaaatcctgcacaccaccaaatctccggcggtttaaacttaattaacggcactcctcagccaagtcaaaagcctccggtcggaggcttttgactacatgcccatggcgtttacgccccgccctgccactcatcgcagtactgttgtaattcattaagcattctgccgacatggaagccatcacaaacggcatgatgaacctgaatcgccagcggcatcagcaccttgtcgccttgcgtataatatttgcccatagtgaaaacgggggcgaagaagttgtccatattggccacgtttaaatcaaaactggtgaaactcacccagggattggctgagacgaaaaacatattctcaataaaccctttagggaaataggccaggttttcaccgtaacacgccacatcttgcgaatatatgtgtagaaactgccggaaatcgtcgtggtattcactccagagcgatgaaaacgtttcagtttgctcatggaaaacggtgtaacaagggtgaacactatcccatatcaccagctcaccgtctttcattgccatacggaactccggatgagcattcatcaggcgggcaagaatgtgaataaaggccggataaaacttgtgcttatttttctttacggtctttaaaaaggccgtaatatccagctgaacggtctggttataggtacattgagtaactgactgaaatgcctcaaaatgttctttacgatgccattgggatatatcaacggtggtatatccagtgatttttttctccattttagcttccttagctcctgaaaatctcgataactcaaaaaatacgcccggtagtgatcttatttcattatggtgaaagttggaacctcttacgtgccaagccaaataggccgt

SEQ ID NO: 119 - DNA, 6681 bp, Artificial Sequence
  Synthetic Polynucleotide
cactcggtcgctacgctccgggcgtgagactgcggcgggcgctgcggacacatacaaagttacccacagattccgtggataagcaggggactaacatgtgaggcaaaacagcagggccgcgccggtggcgtttttccataggctccgccctcctgccagagttcacataaacagacgcttttccggtgcatctgtgggagccgtgaggctcaaccatgaatctgacagtacgggcgaaacccgacaggacttaaagatccccaccgtttccggcgggtcgctccctcttgcgctctcctgttccgaccctgccgtttaccggatacctgttccgcctttctcccttacgggaagtgtggcgctttctcatagctcacacactggtatctcggctcggtgtaggtcgttcgctccaagctgggctgtaagcaagaactccccgttcagcccgactgctgcgccttatccggtaactgttcacttgagtccaacccggaaaagcacggtaaaacgccactggcagcagccattggtaactgggagttcgcagaggatttgtttagctaaacacgcggttgctcttgaagtgtgcgccaaagtccggctacactggaaggacagatttggttgctgtgctctgcgaaagccagttaccacggttaagcagttccccaactgacttaaccttcgatcaaaccacctccccaggtggttttttcgtttacagggcaaaagattacgcgcagaaaaaaaggatctcaagaagatcctttgatcttttctactgaaccgctctagatttcagtgcaatttatctcttcaaatgtagcacctgaagtcagcccaggaggaagaggacatccggtcaaataaaacgaaaggctcagtcgaaagactgggcctttcgttttagacttagggaccctttatgacaacttgacggctacatcattcactttttcttcacaaccggcacggaactcgctcgggctggccccggtgcattttttaaatacccgcgagaaatagagttgatcgtcaaaaccaacattgcgaccgacggtggcgataggcatccgggtggtgctcaaaagcagcttcgcctggctgatacgttggtcctcgcgccagcttaagacgctaatccctaactgctggcggaaaagatgtgacagacgcgacggcgacaagcaaacatgctgtgcgacgctggcgatatcaaaattgctgtctgccaggtgatcgctgatgtactgacaagcctcgcgtacccgattatccatcggtggatggagcgactcgttaatcgcttccatgcgccgcagtaacaattgctcaagcagatttatcgccagcagctccgaatagcgcccttccccttgcccggcgttaatgatttgcccaaacaggtcgctgaaatgcggctggtgcgcttcatccgggcgaaagaaccccgtattggcaaatattgacggccagttaagccattcatgccagtaggcgcgcggacgaaagtaaacccactggtgataccattcgcgagcctccggatgacgaccgtagtgatgaatctctcctggcgggaacagcaaaatatcacccggtcggcaaacaaattctcgtccctgatttttcaccaccccctgaccgcgaatggtgagattgagaatataacctttcattcccagcggtcggtcgataaaaaaatcgagataaccgttggcctcaatcggcgttaaacccgccaccagatgggcattaaacgagtatcccggcagcaggggatcattttgcgcttcagccatacttttcatactcccaccattcagagaagaaaccaattgtccatattgcatcagacattgccgtcactgcgtcttttactggctcttctcgctaacccaaccggtaaccccgcttattaaaagcattctgtaacaaagcgggaccaaagccatgacaaaaacgcgtaacaaaagtgtctataatcacggcagaaaagtccacattgattatttgcacggcgtcacactttgctatgccatagcatttttatccataagattagcggatcctacctgacgctttttatcgcaactctctactgtttctccatacccgtttttttggacgcgtacaactcaagtctgacataaatgaccgctatgagcactgcaattacacgccagatcgttctcgataccgaaaccaccggtatgaaccagattggtgcgcactatgaaggccacaagatcattgagattggtgccgttgaagtggtgaaccgtcgcctgacgggcaataacttccatgtttatctcaaacccgatcggctggtggatccggtggcctttggcgtacatggtattgccgatgaatttttgctcgataagcccacgtttgccgaagtagccgcggagttcatggactatattcgcggcgcggagttggtgatccataacgcagcgttcgaaatcggctttatggacgatgagttttcgttgcttaagcgcgatattccgaagaccaatactttctgtaaggtcaccgatagccttgcggtggcgaggaaaaaatttcccggtaagcgcaacagcctcgatgcgttatgtgctcgctacgaaatagataacagtaaacgaacgctgcacggggcattactcggcgcccagatccttgcggaagtttatctggcgatgaccggtggtcaaacgtcgatggcttttgcgatggaaggagagacacaacagcaacaaggtgaagcaacaattcagcgcattgtacgtcaggcaagtaagttacgcgttgtttttgcgacagatgaagagattgcagctcatgaagcccgtctcgatctggtgcagaagaaaggcggaagttgcctctggcgagcataatttaatatcagtaaaccggacataacccatgaagaaaaatcgcgcttttttgaagtgggcagggggcaagtatcccctgcttgatgatattaaacggcatttgcccaagggcgaatgtctggttgagccttttgtaggtgccgggtcggtgtttctcaacaccgacttttctcgttatatccttgccgatatcaatagcgacctgatcagtctctataacattgtgaagatgcgtactgatgagtacgtacaggccgcacgcgagctgtttgttcccgaaacaaattgcgccgaggtttactatcagttccgcgaagagttcaacaaaagccaggatccgttccgtcgggcggtactgtttttatatttgaaccgctacggttacaacggcctgtgtcgttacaatctgcgcggtgagtttaacgtgccgttcggccgctacaaaaaaccctatttcccggaagcagagttgtatcacttcgctgaaaaagcgcagaatgcctttttctattgtgagtcttacgccgatagcatggcgcgcgcagatgatgcatccgtcgtctattgcgatccgccttatgcaccgctgtctgcgaccgccaactttacggcgtatcacacaaacagttttacgcttgaacaacaagcgcatctggcggagatcgccgaaggtctggttgagcgccatattccagtgctgatctccaatcacgatacgatgttaacgcgtgagtggtatcagcgcgcaaaattgcatgtcgtcaaagttcgacgcagtataagcagcaacggcggcacacgtaaaaaggtggacgaactgctggctttgtacaaaccaggagtcgtttcacccgcgaaaaaataattcagctaagacactgcactggattaagatgaaaacgattgaagttgatgatgaactctacagctatattgccagccacactaagcatatcggcgagagcgcatccgacattttacggcgtatgttgaaattttccgccgcatcacagcctgctgctccggtgacgaaagaggttcgcgttgcgtcacctgctatcgtcgaagcgaagccggtcaaaacgattaaagacaaggttcgcgcaatgcgtgaacttctgctttcggatgaatacgcagagcaaaagcgagcggtcaatcgctttatgctgctgttgtctacactatattctcttgacgcccaggcgtttgccgaagcaacggaatcgttgcacggtcgtacacgcgtttactttgcggcagatgaacaaacgctgctgaaaaatggtaatcagaccaagccgaaacatgtgccaggcacgccgtattgggtgatcaccaacaccaacaccggccgtaaatgcagcatgatcgaacacatcatgcagtcgatgcaattcccggcggaattgattgagaaggtttgcggaactatctaacggctgaaattaatgaggtcatacccaaatggatagttcgtttacgcccattgaacaaatgctaaaatttcgcgccagccgccacgaagattttccttatcaggagatccttctgactcgtctttgcatgcacatgcaaagcaagctgctggagaaccgcaataaaatgctgaaggctcagggaattaacgagacgttgtttatggcgttgattacgctggagtctcaggaaaaccacagtattcagccttctgaattaagttgtgctcttggatcatcccgtaccaacgcgacgcgtattgccgatgaactggaaaaacgcggttggatcgaacgtcgtgaaagcgataacgatcgccgctgcctgcatctgcaattaacggaaaaaggtcacgagtttttgcgcgaggttttaccaccgcagcataactgcctgcatcaactctggtccgcgctcagcacaacagaaaaagatcagctcgagcaaatcacccgcaaattgctctcccgtctcgaccagatggaacaagacggtgtggttctcgaagcgatgagctaataatacaaaaattaggaggaatttcaacatgacaaatttatctgacatcattgaaaaagaaacaggaaaacaactagtgattcaagaatcaattctaatgttaccagaagaagtagaggaagtaattgggaataaaccagaaagtgatattttagttcatactgcttatgatgaaagtacagatgaaaatgtaatgctattaacttcagatgctccagaatataaaccttgggctttagtaattcaagacagtaatggagaaaataaaattaaaatgttataagtcgagattaagtaaaccggaatctgaagatgaccgacgcggaatacgttcgtatccacgaaaaactggacatctacaccttcaaaaaacagttcttcaacaacaaaaaatctgtttctcaccgttgctacgttctgttcgaactgaaacgtcgtggtgaacgtcgtgcgtgcttctggggttacgcggttaacaaaccgcagtctggtaccgaacgtggtatccacgcggaaatcttctctatccgtaaagttgaagaatacctgcgtgacaacccgggtcagttcaccatcaactggtactcttcttggtctccgtgcgcggactgcgcggaaaaaatcctggaatggtacaaccaggaactgcgtggtaacggtcacaccctgaaaatctgggcgtgcaaactgtactacgaaaaaaacgcgcgtaaccagatcggtctgtggaacctgcgtgacaacggtgttggtctgaacgttatggtttctgaacactaccagtgctgccgtaaaatcttcatccagtcttctcacaaccagctgaacgaaaaccgttggctggaaaaaaccctgaaacgtgcggaaaaacgtcgttctgaactgtctatcatgatccaggttaaaatcctgcacaccaccaaatctccggcggtttaaacttaattaacggcactcctcagccaagtcaaaagcctccggtcggaggcttttgactacatgcccatggcgtttacgccccgccctgccactcatcgcagtactgttgtaattcattaagcattctgccgacatggaagccatcacaaacggcatgatgaacctgaatcgccagcggcatcagcaccttgtcgccttgcgtataatatttgcccatagtgaaaacgggggcgaagaagttgtccatattggccacgtttaaatcaaaactggtgaaactcacccagggattggctgagacgaaaaacatattctcaataaaccctttagggaaataggccaggttttcaccgtaacacgccacatcttgcgaatatatgtgtagaaactgccggaaatcgtcgtggtattcactccagagcgatgaaaacgtttcagtttgctcatggaaaacggtgtaacaagggtgaacactatcccatatcaccagctcaccgtctttcattgccatacggaactccggatgagcattcatcaggcgggcaagaatgtgaataaaggccggataaaacttgtgcttatttttctttacggtctttaaaaaggccgtaatatccagctgaacggtctggttataggtacattgagtaactgactgaaatgcctcaaaatgttctttacgatgccattgggatatatcaacggtggtatatccagtgatttttttctccattttagcttccttagctcctgaaaatctcgataactcaaaaaatacgcccggtagtgatcttatttcattatggtgaaagttggaacctcttacgtgccaagccaaataggccgt

SEQ ID NO: 120 - DNA, 6681 bp, Artificial Sequence
  Synthetic Polynucleotide
cactcggtcgctacgctccgggcgtgagactgcggcgggcgctgcggacacatacaaagttacccacagattccgtggataagcaggggactaacatgtgaggcaaaacagcagggccgcgccggtggcgtttttccataggctccgccctcctgccagagttcacataaacagacgcttttccggtgcatctgtgggagccgtgaggctcaaccatgaatctgacagtacgggcgaaacccgacaggacttaaagatccccaccgtttccggcgggtcgctccctcttgcgctctcctgttccgaccctgccgtttaccggatacctgttccgcctttctcccttacgggaagtgtggcgctttctcatagctcacacactggtatctcggctcggtgtaggtcgttcgctccaagctgggctgtaagcaagaactccccgttcagcccgactgctgcgccttatccggtaactgttcacttgagtccaacccggaaaagcacggtaaaacgccactggcagcagccattggtaactgggagttcgcagaggatttgtttagctaaacacgcggttgctcttgaagtgtgcgccaaagtccggctacactggaaggacagatttggttgctgtgctctgcgaaagccagttaccacggttaagcagttccccaactgacttaaccttcgatcaaaccacctccccaggtggttttttcgtttacagggcaaaagattacgcgcagaaaaaaaggatctcaagaagatcctttgatcttttctactgaaccgctctagatttcagtgcaatttatctcttcaaatgtagcacctgaagtcagcccaggaggaagaggacatccggtcaaataaaacgaaaggctcagtcgaaagactgggcctttcgttttagacttagggaccctttatgacaacttgacggctacatcattcactttttcttcacaaccggcacggaactcgctcgggctggccccggtgcattttttaaatacccgcgagaaatagagttgatcgtcaaaaccaacattgcgaccgacggtggcgataggcatccgggtggtgctcaaaagcagcttcgcctggctgatacgttggtcctcgcgccagcttaagacgctaatccctaactgctggcggaaaagatgtgacagacgcgacggcgacaagcaaacatgctgtgcgacgctggcgatatcaaaattgctgtctgccaggtgatcgctgatgtactgacaagcctcgcgtacccgattatccatcggtggatggagcgactcgttaatcgcttccatgcgccgcagtaacaattgctcaagcagatttatcgccagcagctccgaatagcgcccttccccttgcccggcgttaatgatttgcccaaacaggtcgctgaaatgcggctggtgcgcttcatccgggcgaaagaaccccgtattggcaaatattgacggccagttaagccattcatgccagtaggcgcgcggacgaaagtaaacccactggtgataccattcgcgagcctccggatgacgaccgtagtgatgaatctctcctggcgggaacagcaaaatatcacccggtcggcaaacaaattctcgtccctgatttttcaccaccccctgaccgcgaatggtgagattgagaatataacctttcattcccagcggtcggtcgataaaaaaatcgagataaccgttggcctcaatcggcgttaaacccgccaccagatgggcattaaacgagtatcccggcagcaggggatcattttgcgcttcagccatacttttcatactcccaccattcagagaagaaaccaattgtccatattgcatcagacattgccgtcactgcgtcttttactggctcttctcgctaacccaaccggtaaccccgcttattaaaagcattctgtaacaaagcgggaccaaagccatgacaaaaacgcgtaacaaaagtgtctataatcacggcagaaaagtccacattgattatttgcacggcgtcacactttgctatgccatagcatttttatccataagattagcggatcctacctgacgctttttatcgcaactctctactgtttctccatacccgtttttttggacgcgtacaactcaagtctgacataaatgaccgctatgagcactgcaattacacgccagatcgttctcgataccggcaccaccggtatgaaccagattggtgcgcactatgaaggccacatgatcattgagattggtgccgttgaagtggtgaaccgtcgcctgacgggcaataacttccatgtttatctcaaacccgatcggctggtggatccggaagcctttggcgtacatggtattgccgatgaatttttgctcgataagcccacgtttgccgaagtagccgatgagttcatggactatattcgcggcgcggagttggtgatccataacgcagcgttcgatatcggctttatggactacgagttttcgttgcttaagcgcgatattccgaagaccaatactttctgtaaggtcaccgatagccttgcggtggcgaggaaaatgtttcccggtaagcgcaacagcctcgatgcgttatgtgctcgctacgaaatagataacagtaaacgaacgctgcacggggcattactcgatgcccagatccttgcggaagtttatctggcgatgaccggtggtcaaacgtcgatggcttttgcgatggaaggagagacacaacagcaacaaggtgaagcaacaattcagcgcattgtacgtcaggcaagtaagttacgcgttgtttttgcgacagatgaagagattgcagctcatgaagcccgtctcgatctggtgcagaagaaaggcggaagttgcctctggcgagcataatttaatatcagtaaaccggacataacccatgaagaaaaatcgcgcttttttgaagtgggcagggggcaagtatcccctgcttgatgatattaaacggcatttgcccaagggcgaatgtctggttgagccttttgtaggtgccgggtcggtgtttctcaacaccgacttttctcgttatatccttgccgatatcaatagcgacctgatcagtctctataacattgtgaagatgcgtactgatgagtacgtacaggccgcacgcgagctgtttgttcccgaaacaaattgcgccgaggtttactatcagttccgcgaagagttcaacaaaagccaggatccgttccgtcgggcggtactgtttttatatttgaaccgctacggttacaacggcctgtgtcgttacaatctgcgcggtgagtttaacgtgccgttcggccgctacaaaaaaccctatttcccggaagcagagttgtatcacttcgctgaaaaagcgcagaatgcctttttctattgtgagtcttacgccgatagcatggcgcgcgcagatgatgcatccgtcgtctattgcgatccgccttatgcaccgctgtctgcgaccgccaactttacggcgtatcacacaaacagttttacgcttgaacaacaagcgcatctggcggagatcgccgaaggtctggttgagcgccatattccagtgctgatctccaatcacgatacgatgttaacgcgtgagtggtatcagcgcgcaaaattgcatgtcgtcaaagttcgacgcagtataagcagcaacggcggcacacgtaaaaaggtggacgaactgctggctttgtacaaaccaggagtcgtttcacccgcgaaaaaataattcagctaagacactgcactggattaagatgaaaacgattgaagttgatgatgaactctacagctatattgccagccacactaagcatatcggcgagagcgcatccgacattttacggcgtatgttgaaattttccgccgcatcacagcctgctgctccggtgacgaaagaggttcgcgttgcgtcacctgctatcgtcgaagcgaagccggtcaaaacgattaaagacaaggttcgcgcaatgcgtgaacttctgctttcggatgaatacgcagagcaaaagcgagcggtcaatcgctttatgctgctgttgtctacactatattctcttgacgcccaggcgtttgccgaagcaacggaatcgttgcacggtcgtacacgcgtttactttgcggcagatgaacaaacgctgctgaaaaatggtaatcagaccaagccgaaacatgtgccaggcacgccgtattgggtgatcaccaacaccaacaccggccgtaaatgcagcatgatcgaacacatcatgcagtcgatgcaattcccggcggaattgattgagaaggtttgcggaactatctaacggctgaaattaatgaggtcatacccaaatggatagttcgtttacgcccattgaacaaatgctaaaatttcgcgccagccgccacgaagattttccttatcaggagatccttctgactcgtctttgcatgcacatgcaaagcaagctgctggagaaccgcaataaaatgctgaaggctcagggaattaacgagacgttgtttatggcgttgattacgctggagtctcaggaaaaccacagtattcagccttctgaattaagttgtgctcttggatcatcccgtaccaacgcgacgcgtattgccgatgaactggaaaaacgcggttggatcgaacgtcgtgaaagcgataacgatcgccgctgcctgcatctgcaattaacggaaaaaggtcacgagtttttgcgcgaggttttaccaccgcagcataactgcctgcatcaactctggtccgcgctcagcacaacagaaaaagatcagctcgagcaaatcacccgcaaattgctctcccgtctcgaccagatggaacaagacggtgtggttctcgaagcgatgagctaataatacaaaaattaggaggaatttcaacatgacaaatttatctgacatcattgaaaaagaaacaggaaaacaactagtgattcaagaatcaattctaatgttaccagaagaagtagaggaagtaattgggaataaaccagaaagtgatattttagttcatactgcttatgatgaaagtacagatgaaaatgtaatgctattaacttcagatgctccagaatataaaccttgggctttagtaattcaagacagtaatggagaaaataaaattaaaatgttataagtcgagattaagtaaaccggaatctgaagatgaccgacgcggaatacgttcgtatccacgaaaaactggacatctacaccttcaaaaaacagttcttcaacaacaaaaaatctgtttctcaccgttgctacgttctgttcgaactgaaacgtcgtggtgaacgtcgtgcgtgcttctggggttacgcggttaacaaaccgcagtctggtaccgaacgtggtatccacgcggaaatcttctctatccgtaaagttgaagaatacctgcgtgacaacccgggtcagttcaccatcaactggtactcttcttggtctccgtgcgcggactgcgcggaaaaaatcctggaatggtacaaccaggaactgcgtggtaacggtcacaccctgaaaatctgggcgtgcaaactgtactacgaaaaaaacgcgcgtaaccagatcggtctgtggaacctgcgtgacaacggtgttggtctgaacgttatggtttctgaacactaccagtgctgccgtaaaatcttcatccagtcttctcacaaccagctgaacgaaaaccgttggctggaaaaaaccctgaaacgtgcggaaaaacgtcgttctgaactgtctatcatgatccaggttaaaatcctgcacaccaccaaatctccggcggtttaaacttaattaacggcactcctcagccaagtcaaaagcctccggtcggaggcttttgactacatgcccatggcgtttacgccccgccctgccactcatcgcagtactgttgtaattcattaagcattctgccgacatggaagccatcacaaacggcatgatgaacctgaatcgccagcggcatcagcaccttgtcgccttgcgtataatatttgcccatagtgaaaacgggggcgaagaagttgtccatattggccacgtttaaatcaaaactggtgaaactcacccagggattggctgagacgaaaaacatattctcaataaaccctttagggaaataggccaggttttcaccgtaacacgccacatcttgcgaatatatgtgtagaaactgccggaaatcgtcgtggtattcactccagagcgatgaaaacgtttcagtttgctcatggaaaacggtgtaacaagggtgaacactatcccatatcaccagctcaccgtctttcattgccatacggaactccggatgagcattcatcaggcgggcaagaatgtgaataaaggccggataaaacttgtgcttatttttctttacggtctttaaaaaggccgtaatatccagctgaacggtctggttataggtacattgagtaactgactgaaatgcctcaaaatgttctttacgatgccattgggatatatcaacggtggtatatccagtgatttttttctccattttagcttccttagctcctgaaaatctcgataactcaaaaaatacgcccggtagtgatcttatttcattatggtgaaagttggaacctcttacgtgccaagccaaataggccgt

SEQ ID NO: 121 - DNA, 6681 bp, Artificial Sequence
  Synthetic Polynucleotide
cactcggtcgctacgctccgggcgtgagactgcggcgggcgctgcggacacatacaaagttacccacagattccgtggataagcaggggactaacatgtgaggcaaaacagcagggccgcgccggtggcgtttttccataggctccgccctcctgccagagttcacataaacagacgcttttccggtgcatctgtgggagccgtgaggctcaaccatgaatctgacagtacgggcgaaacccgacaggacttaaagatccccaccgtttccggcgggtcgctccctcttgcgctctcctgttccgaccctgccgtttaccggatacctgttccgcctttctcccttacgggaagtgtggcgctttctcatagctcacacactggtatctcggctcggtgtaggtcgttcgctccaagctgggctgtaagcaagaactccccgttcagcccgactgctgcgccttatccggtaactgttcacttgagtccaacccggaaaagcacggtaaaacgccactggcagcagccattggtaactgggagttcgcagaggatttgtttagctaaacacgcggttgctcttgaagtgtgcgccaaagtccggctacactggaaggacagatttggttgctgtgctctgcgaaagccagttaccacggttaagcagttccccaactgacttaaccttcgatcaaaccacctccccaggtggttttttcgtttacagggcaaaagattacgcgcagaaaaaaaggatctcaagaagatcctttgatcttttctactgaaccgctctagatttcagtgcaatttatctcttcaaatgtagcacctgaagtcagcccaggaggaagaggacatccggtcaaataaaacgaaaggctcagtcgaaagactgggcctttcgttttagacttagggaccctttatgacaacttgacggctacatcattcactttttcttcacaaccggcacggaactcgctcgggctggccccggtgcattttttaaatacccgcgagaaatagagttgatcgtcaaaaccaacattgcgaccgacggtggcgataggcatccgggtggtgctcaaaagcagcttcgcctggctgatacgttggtcctcgcgccagcttaagacgctaatccctaactgctggcggaaaagatgtgacagacgcgacggcgacaagcaaacatgctgtgcgacgctggcgatatcaaaattgctgtctgccaggtgatcgctgatgtactgacaagcctcgcgtacccgattatccatcggtggatggagcgactcgttaatcgcttccatgcgccgcagtaacaattgctcaagcagatttatcgccagcagctccgaatagcgcccttccccttgcccggcgttaatgatttgcccaaacaggtcgctgaaatgcggctggtgcgcttcatccgggcgaaagaaccccgtattggcaaatattgacggccagttaagccattcatgccagtaggcgcgcggacgaaagtaaacccactggtgataccattcgcgagcctccggatgacgaccgtagtgatgaatctctcctggcgggaacagcaaaatatcacccggtcggcaaacaaattctcgtccctgatttttcaccaccccctgaccgcgaatggtgagattgagaatataacctttcattcccagcggtcggtcgataaaaaaatcgagataaccgttggcctcaatcggcgttaaacccgccaccagatgggcattaaacgagtatcccggcagcaggggatcattttgcgcttcagccatacttttcatactcccaccattcagagaagaaaccaattgtccatattgcatcagacattgccgtcactgcgtcttttactggctcttctcgctaacccaaccggtaaccccgcttattaaaagcattctgtaacaaagcgggaccaaagccatgacaaaaacgcgtaacaaaagtgtctataatcacggcagaaaagtccacattgattatttgcacggcgtcacactttgctatgccatagcatttttatccataagattagcggatcctacctgacgctttttatcgcaactctctactgtttctccatacccgtttttttggacgcgtacaactcaagtctgacataaatgaccgctatgagcactgcaattacacgccagatcgttctcgataccgtgaccaccggtatgaaccagattggtgcgcactatgaaggccacaagatcattgagattggtgccgttgaagtggtgaaccgtcgcctgacgggcaataacttccatgtttatctcaaacccgatcggctggtggatccggaagcctttggcgtacatggtattgccgatgaatttttgctcgataagcccacgtttgccgaagtagccgatgagttcatggactatattcgcggcgcggagttggtgatccataacgcagcgttcgatatcggctttatggactacgagttttcgttgcttaagcgcgatattccgaagaccaatactttctgtaaggtcaccgatagccttgcggtggcgaggaaaatgtttcccggtaagcgcaacagcctcgatgcgttatgtgctcgctacgaaatagatagcagtaaacgaacgctgcacggggcattactcgatgcccagatccttgcggtggtttatctggcgatgaccggtggtcaaacgtcgatggcttttgcgatggaaggagagacacaacagcaacaaggtgaagcaacaattcagcgcattgtacgtcaggcaagtaagttacgcgttgtttttgcgacagatgaagagattgcagctcatgaagcccgtctcaacctggtgcagaagaaaggcggaagttgcctctggcgagcataatttaatatcagtaaaccggacataacccatgaagaaaaatcgcgcttttttgaagtgggcagggggcaagtatcccctgcttgatgatattaaacggcatttgcccaagggcgaatgtctggttgagccttttgtaggtgccgggtcggtgtttctcaacaccgacttttctcgttatatccttgccgatatcaatagcgacctgatcagtctctataacattgtgaagatgcgtactgatgagtacgtacaggccgcacgcgagctgtttgttcccgaaacaaattgcgccgaggtttactatcagttccgcgaagagttcaacaaaagccaggatccgttccgtcgggcggtactgtttttatatttgaaccgctacggttacaacggcctgtgtcgttacaatctgcgcggtgagtttaacgtgccgttcggccgctacaaaaaaccctatttcccggaagcagagttgtatcacttcgctgaaaaagcgcagaatgcctttttctattgtgagtcttacgccgatagcatggcgcgcgcagatgatgcatccgtcgtctattgcgatccgccttatgcaccgctgtctgcgaccgccaactttacggcgtatcacacaaacagttttacgcttgaacaacaagcgcatctggcggagatcgccgaaggtctggttgagcgccatattccagtgctgatctccaatcacgatacgatgttaacgcgtgagtggtatcagcgcgcaaaattgcatgtcgtcaaagttcgacgcagtataagcagcaacggcggcacacgtaaaaaggtggacgaactgctggctttgtacaaaccaggagtcgtttcacccgcgaaaaaataattcagctaagacactgcactggattaagatgaaaacgattgaagttgatgatgaactctacagctatattgccagccacactaagcatatcggcgagagcgcatccgacattttacggcgtatgttgaaattttccgccgcatcacagcctgctgctccggtgacgaaagaggttcgcgttgcgtcacctgctatcgtcgaagcgaagccggtcaaaacgattaaagacaaggttcgcgcaatgcgtgaacttctgctttcggatgaatacgcagagcaaaagcgagcggtcaatcgctttatgctgctgttgtctacactatattctcttgacgcccaggcgtttgccgaagcaacggaatcgttgcacggtcgtacacgcgtttactttgcggcagatgaacaaacgctgctgaaaaatggtaatcagaccaagccgaaacatgtgccaggcacgccgtattgggtgatcaccaacaccaacaccggccgtaaatgcagcatgatcgaacacatcatgcagtcgatgcaattcccggcggaattgattgagaaggtttgcggaactatctaacggctgaaattaatgaggtcatacccaaatggatagttcgtttacgcccattgaacaaatgctaaaatttcgcgccagccgccacgaagattttccttatcaggagatccttctgactcgtctttgcatgcacatgcaaagcaagctgctggagaaccgcaataaaatgctgaaggctcagggaattaacgagacgttgtttatggcgttgattacgctggagtctcaggaaaaccacagtattcagccttctgaattaagttgtgctcttggatcatcccgtaccaacgcgacgcgtattgccgatgaactggaaaaacgcggttggatcgaacgtcgtgaaagcgataacgatcgccgctgcctgcatctgcaattaacggaaaaaggtcacgagtttttgcgcgaggttttaccaccgcagcataactgcctgcatcaactctggtccgcgctcagcacaacagaaaaagatcagctcgagcaaatcacccgcaaattgctctcccgtctcgaccagatggaacaagacggtgtggttctcgaagcgatgagctaataatacaaaaattaggaggaatttcaacatgacaaatttatctgacatcattgaaaaagaaacaggaaaacaactagtgattcaagaatcaattctaatgttaccagaagaagtagaggaagtaattgggaataaaccagaaagtgatattttagttcatactgcttatgatgaaagtacagatgaaaatgtaatgctattaacttcagatgctccagaatataaaccttgggctttagtaattcaagacagtaatggagaaaataaaattaaaatgttataagtcgagattaagtaaaccggaatctgaagatgaccgacgcggaatacgttcgtatccacgaaaaactggacatctacaccttcaaaaaacagttcttcaacaacaaaaaatctgtttctcaccgttgctacgttctgttcgaactgaaacgtcgtggtgaacgtcgtgcgtgcttctggggttacgcggttaacaaaccgcagtctggtaccgaacgtggtatccacgcggaaatcttctctatccgtaaagttgaagaatacctgcgtgacaacccgggtcagttcaccatcaactggtactcttcttggtctccgtgcgcggactgcgcggaaaaaatcctggaatggtacaaccaggaactgcgtggtaacggtcacaccctgaaaatctgggcgtgcaaactgtactacgaaaaaaacgcgcgtaaccagatcggtctgtggaacctgcgtgacaacggtgttggtctgaacgttatggtttctgaacactaccagtgctgccgtaaaatcttcatccagtcttctcacaaccagctgaacgaaaaccgttggctggaaaaaaccctgaaacgtgcggaaaaacgtcgttctgaactgtctatcatgatccaggttaaaatcctgcacaccaccaaatctccggcggtttaaacttaattaacggcactcctcagccaagtcaaaagcctccggtcggaggcttttgactacatgcccatggcgtttacgccccgccctgccactcatcgcagtactgttgtaattcattaagcattctgccgacatggaagccatcacaaacggcatgatgaacctgaatcgccagcggcatcagcaccttgtcgccttgcgtataatatttgcccatagtgaaaacgggggcgaagaagttgtccatattggccacgtttaaatcaaaactggtgaaactcacccagggattggctgagacgaaaaacatattctcaataaaccctttagggaaataggccaggttttcaccgtaacacgccacatcttgcgaatatatgtgtagaaactgccggaaatcgtcgtggtattcactccagagcgatgaaaacgtttcagtttgctcatggaaaacggtgtaacaagggtgaacactatcccatatcaccagctcaccgtctttcattgccatacggaactccggatgagcattcatcaggcgggcaagaatgtgaataaaggccggataaaacttgtgcttatttttctttacggtctttaaaaaggccgtaatatccagctgaacggtctggttataggtacattgagtaactgactgaaatgcctcaaaatgttctttacgatgccattgggatatatcaacggtggtatatccagtgatttttttctccattttagcttccttagctcctgaaaatctcgataactcaaaaaatacgcccggtagtgatcttatttcattatggtgaaagttggaacctcttacgtgccaagccaaataggccgt

SEQ ID NO: 122 - DNA, 6681 bp, Artificial Sequence
  Synthetic Polynucleotide
cactcggtcgctacgctccgggcgtgagactgcggcgggcgctgcggacacatacaaagttacccacagattccgtggataagcaggggactaacatgtgaggcaaaacagcagggccgcgccggtggcgtttttccataggctccgccctcctgccagagttcacataaacagacgcttttccggtgcatctgtgggagccgtgaggctcaaccatgaatctgacagtacgggcgaaacccgacaggacttaaagatccccaccgtttccggcgggtcgctccctcttgcgctctcctgttccgaccctgccgtttaccggatacctgttccgcctttctcccttacgggaagtgtggcgctttctcatagctcacacactggtatctcggctcggtgtaggtcgttcgctccaagctgggctgtaagcaagaactccccgttcagcccgactgctgcgccttatccggtaactgttcacttgagtccaacccggaaaagcacggtaaaacgccactggcagcagccattggtaactgggagttcgcagaggatttgtttagctaaacacgcggttgctcttgaagtgtgcgccaaagtccggctacactggaaggacagatttggttgctgtgctctgcgaaagccagttaccacggttaagcagttccccaactgacttaaccttcgatcaaaccacctccccaggtggttttttcgtttacagggcaaaagattacgcgcagaaaaaaaggatctcaagaagatcctttgatcttttctactgaaccgctctagatttcagtgcaatttatctcttcaaatgtagcacctgaagtcagcccaggaggaagaggacatccggtcaaataaaacgaaaggctcagtcgaaagactgggcctttcgttttagacttagggaccctttatgacaacttgacggctacatcattcactttttcttcacaaccggcacggaactcgctcgggctggccccggtgcattttttaaatacccgcgagaaatagagttgatcgtcaaaaccaacattgcgaccgacggtggcgataggcatccgggtggtgctcaaaagcagcttcgcctggctgatacgttggtcctcgcgccagcttaagacgctaatccctaactgctggcggaaaagatgtgacagacgcgacggcgacaagcaaacatgctgtgcgacgctggcgatatcaaaattgctgtctgccaggtgatcgctgatgtactgacaagcctcgcgtacccgattatccatcggtggatggagcgactcgttaatcgcttccatgcgccgcagtaacaattgctcaagcagatttatcgccagcagctccgaatagcgcccttccccttgcccggcgttaatgatttgcccaaacaggtcgctgaaatgcggctggtgcgcttcatccgggcgaaagaaccccgtattggcaaatattgacggccagttaagccattcatgccagtaggcgcgcggacgaaagtaaacccactggtgataccattcgcgagcctccggatgacgaccgtagtgatgaatctctcctggcgggaacagcaaaatatcacccggtcggcaaacaaattctcgtccctgatttttcaccaccccctgaccgcgaatggtgagattgagaatataacctttcattcccagcggtcggtcgataaaaaaatcgagataaccgttggcctcaatcggcgttaaacccgccaccagatgggcattaaacgagtatcccggcagcaggggatcattttgcgcttcagccatacttttcatactcccaccattcagagaagaaaccaattgtccatattgcatcagacattgccgtcactgcgtcttttactggctcttctcgctaacccaaccggtaaccccgcttattaaaagcattctgtaacaaagcgggaccaaagccatgacaaaaacgcgtaacaaaagtgtctataatcacggcagaaaagtccacattgattatttgcacggcgtcacactttgctatgccatagcatttttatccataagattagcggatcctacctgacgctttttatcgcaactctctactgtttctccatacccgtttttttggacgcgtacaactcaagtctgacataaatgaccgctatgagcactgcaattacacgccagatcgttctcgataccgaaaccatcggtatgaaccagattggtgcgcactatgaaggccacaagatcattgagattggtgccgttgaagtggtgaaccgtcgcctgacgggcaataacttccatgtttatctcaaacccgatcggctggtggatccggaagcctttggcgtacatggtattgccgatgaatttttgctcgataagcccacgtttgccgaagtagccgatgagttcatggactatattcgcggcgcggagttggtgatccataacgcagcgttcgatatcggctttatggactacgagttttcgttgcttaagcgcgatattccgaagaccaatactttctgtaaggtcaccgatagccttgcggtggcgaggaaaatgtttcccggtaagcgcaacagcctcgatgcgttatgtgctcgctacgaaatagataacagtaaactgacgctgcacggggcattactcgatgcccagatccttgcggaagtttatctggcgatgaccggtggtcaaacgtcgatggcttttgcgatggaaggagagacacaacagcaacaaggtgaagcaacaattcagcgcattgtacgtcaggcaagtaagttacgcgttgtttttgcgacagatgaagagattgcagctcatgaagcccgtctcgatctggtgcagaagaaaggcggaagttgcctctggcgagcataatttaatatcagtaaaccggacataacccatgaagaaaaatcgcgcttttttgaagtgggcagggggcaagtatcccctgcttgatgatattaaacggcatttgcccaagggcgaatgtctggttgagccttttgtaggtgccgggtcggtgtttctcaacaccgacttttctcgttatatccttgccgatatcaatagcgacctgatcagtctctataacattgtgaagatgcgtactgatgagtacgtacaggccgcacgcgagctgtttgttcccgaaacaaattgcgccgaggtttactatcagttccgcgaagagttcaacaaaagccaggatccgttccgtcgggcggtactgtttttatatttgaaccgctacggttacaacggcctgtgtcgttacaatctgcgcggtgagtttaacgtgccgttcggccgctacaaaaaaccctatttcccggaagcagagttgtatcacttcgctgaaaaagcgcagaatgcctttttctattgtgagtcttacgccgatagcatggcgcgcgcagatgatgcatccgtcgtctattgcgatccgccttatgcaccgctgtctgcgaccgccaactttacggcgtatcacacaaacagttttacgcttgaacaacaagcgcatctggcggagatcgccgaaggtctggttgagcgccatattccagtgctgatctccaatcacgatacgatgttaacgcgtgagtggtatcagcgcgcaaaattgcatgtcgtcaaagttcgacgcagtataagcagcaacggcggcacacgtaaaaaggtggacgaactgctggctttgtacaaaccaggagtcgtttcacccgcgaaaaaataattcagctaagacactgcactggattaagatgaaaacgattgaagttgatgatgaactctacagctatattgccagccacactaagcatatcggcgagagcgcatccgacattttacggcgtatgttgaaattttccgccgcatcacagcctgctgctccggtgacgaaagaggttcgcgttgcgtcacctgctatcgtcgaagcgaagccggtcaaaacgattaaagacaaggttcgcgcaatgcgtgaacttctgctttcggatgaatacgcagagcaaaagcgagcggtcaatcgctttatgctgctgttgtctacactatattctcttgacgcccaggcgtttgccgaagcaacggaatcgttgcacggtcgtacacgcgtttactttgcggcagatgaacaaacgctgctgaaaaatggtaatcagaccaagccgaaacatgtgccaggcacgccgtattgggtgatcaccaacaccaacaccggccgtaaatgcagcatgatcgaacacatcatgcagtcgatgcaattcccggcggaattgattgagaaggtttgcggaactatctaacggctgaaattaatgaggtcatacccaaatggatagttcgtttacgcccattgaacaaatgctaaaatttcgcgccagccgccacgaagattttccttatcaggagatccttctgactcgtctttgcatgcacatgcaaagcaagctgctggagaaccgcaataaaatgctgaaggctcagggaattaacgagacgttgtttatggcgttgattacgctggagtctcaggaaaaccacagtattcagccttctgaattaagttgtgctcttggatcatcccgtaccaacgcgacgcgtattgccgatgaactggaaaaacgcggttggatcgaacgtcgtgaaagcgataacgatcgccgctgcctgcatctgcaattaacggaaaaaggtcacgagtttttgcgcgaggttttaccaccgcagcataactgcctgcatcaactctggtccgcgctcagcacaacagaaaaagatcagctcgagcaaatcacccgcaaattgctctcccgtctcgaccagatggaacaagacggtgtggttctcgaagcgatgagctaataatacaaaaattaggaggaatttcaacatgacaaatttatctgacatcattgaaaaagaaacaggaaaacaactagtgattcaagaatcaattctaatgttaccagaagaagtagaggaagtaattgggaataaaccagaaagtgatattttagttcatactgcttatgatgaaagtacagatgaaaatgtaatgctattaacttcagatgctccagaatataaaccttgggctttagtaattcaagacagtaatggagaaaataaaattaaaatgttataagtcgagattaagtaaaccggaatctgaagatgaccgacgcggaatacgttcgtatccacgaaaaactggacatctacaccttcaaaaaacagttcttcaacaacaaaaaatctgtttctcaccgttgctacgttctgttcgaactgaaacgtcgtggtgaacgtcgtgcgtgcttctggggttacgcggttaacaaaccgcagtctggtaccgaacgtggtatccacgcggaaatcttctctatccgtaaagttgaagaatacctgcgtgacaacccgggtcagttcaccatcaactggtactcttcttggtctccgtgcgcggactgcgcggaaaaaatcctggaatggtacaaccaggaactgcgtggtaacggtcacaccctgaaaatctgggcgtgcaaactgtactacgaaaaaaacgcgcgtaaccagatcggtctgtggaacctgcgtgacaacggtgttggtctgaacgttatggtttctgaacactaccagtgctgccgtaaaatcttcatccagtcttctcacaaccagctgaacgaaaaccgttggctggaaaaaaccctgaaacgtgcggaaaaacgtcgttctgaactgtctatcatgatccaggttaaaatcctgcacaccaccaaatctccggcggtttaaacttaattaacggcactcctcagccaagtcaaaagcctccggtcggaggcttttgactacatgcccatggcgtttacgccccgccctgccactcatcgcagtactgttgtaattcattaagcattctgccgacatggaagccatcacaaacggcatgatgaacctgaatcgccagcggcatcagcaccttgtcgccttgcgtataatatttgcccatagtgaaaacgggggcgaagaagttgtccatattggccacgtttaaatcaaaactggtgaaactcacccagggattggctgagacgaaaaacatattctcaataaaccctttagggaaataggccaggttttcaccgtaacacgccacatcttgcgaatatatgtgtagaaactgccggaaatcgtcgtggtattcactccagagcgatgaaaacgtttcagtttgctcatggaaaacggtgtaacaagggtgaacactatcccatatcaccagctcaccgtctttcattgccatacggaactccggatgagcattcatcaggcgggcaagaatgtgaataaaggccggataaaacttgtgcttatttttctttacggtctttaaaaaggccgtaatatccagctgaacggtctggttataggtacattgagtaactgactgaaatgcctcaaaatgttctttacgatgccattgggatatatcaacggtggtatatccagtgatttttttctccattttagcttccttagctcctgaaaatctcgataactcaaaaaatacgcccggtagtgatcttatttcattatggtgaaagttggaacctcttacgtgccaagccaaataggccgt

SEQ ID NO: 123 - DNA, 6681 bp, Artificial Sequence
  Synthetic Polynucleotide
cactcggtcgctacgctccgggcgtgagactgcggcgggcgctgcggacacatacaaagttacccacagattccgtggataagcaggggactaacatgtgaggcaaaacagcagggccgcgccggtggcgtttttccataggctccgccctcctgccagagttcacataaacagacgcttttccggtgcatctgtgggagccgtgaggctcaaccatgaatctgacagtacgggcgaaacccgacaggacttaaagatccccaccgtttccggcgggtcgctccctcttgcgctctcctgttccgaccctgccgtttaccggatacctgttccgcctttctcccttacgggaagtgtggcgctttctcatagctcacacactggtatctcggctcggtgtaggtcgttcgctccaagctgggctgtaagcaagaactccccgttcagcccgactgctgcgccttatccggtaactgttcacttgagtccaacccggaaaagcacggtaaaacgccactggcagcagccattggtaactgggagttcgcagaggatttgtttagctaaacacgcggttgctcttgaagtgtgcgccaaagtccggctacactggaaggacagatttggttgctgtgctctgcgaaagccagttaccacggttaagcagttccccaactgacttaaccttcgatcaaaccacctccccaggtggttttttcgtttacagggcaaaagattacgcgcagaaaaaaaggatctcaagaagatcctttgatcttttctactgaaccgctctagatttcagtgcaatttatctcttcaaatgtagcacctgaagtcagcccaggaggaagaggacatccggtcaaataaaacgaaaggctcagtcgaaagactgggcctttcgttttagacttagggaccctttatgacaacttgacggctacatcattcactttttcttcacaaccggcacggaactcgctcgggctggccccggtgcattttttaaatacccgcgagaaatagagttgatcgtcaaaaccaacattgcgaccgacggtggcgataggcatccgggtggtgctcaaaagcagcttcgcctggctgatacgttggtcctcgcgccagcttaagacgctaatccctaactgctggcggaaaagatgtgacagacgcgacggcgacaagcaaacatgctgtgcgacgctggcgatatcaaaattgctgtctgccaggtgatcgctgatgtactgacaagcctcgcgtacccgattatccatcggtggatggagcgactcgttaatcgcttccatgcgccgcagtaacaattgctcaagcagatttatcgccagcagctccgaatagcgcccttccccttgcccggcgttaatgatttgcccaaacaggtcgctgaaatgcggctggtgcgcttcatccgggcgaaagaaccccgtattggcaaatattgacggccagttaagccattcatgccagtaggcgcgcggacgaaagtaaacccactggtgataccattcgcgagcctccggatgacgaccgtagtgatgaatctctcctggcgggaacagcaaaatatcacccggtcggcaaacaaattctcgtccctgatttttcaccaccccctgaccgcgaatggtgagattgagaatataacctttcattcccagcggtcggtcgataaaaaaatcgagataaccgttggcctcaatcggcgttaaacccgccaccagatgggcattaaacgagtatcccggcagcaggggatcattttgcgcttcagccatacttttcatactcccaccattcagagaagaaaccaattgtccatattgcatcagacattgccgtcactgcgtcttttactggctcttctcgctaacccaaccggtaaccccgcttattaaaagcattctgtaacaaagcgggaccaaagccatgacaaaaacgcgtaacaaaagtgtctataatcacggcagaaaagtccacattgattatttgcacggcgtcacactttgctatgccatagcatttttatccataagattagcggatcctacctgacgctttttatcgcaactctctactgtttctccatacccgtttttttggacgcgtacaactcaagtctgacataaatgaccgctatgagcactgcaattacacgccagatcgttctcgataccgaaaccaccggtatgaaccagattggtgcgcactatgaaggccacaagatcattgagattggtgccgttgaagtggtgaaccgtcgcctgacgggcaataacttccatgtttatctcaaacccgatcggctggtggatccggaagcctttggcgtacatggtattgccgatgaatttttgctcgataagcccacgtttgccgaagtagccgatgagttcatggactatattcgcggcgcggagttggtgatccataacgcagcgatcgatatcggctttatggactacgagttttcgttgcttcgtcgcgatattccgaagaccaatactttctgtaaggtcaccgatagccttgcggtggcgaggaaaatgtttcccggtaagcgcaacagcctcaacgcgttatgtgctcgctacgaaatagataacagtaaacgaacgctgcacggggcattactcgatgcccagatccttgcggaaggttatctggcgatgaccggtggtcaaacgtcgatggcttttgcgatggaaggagagacacaacagcaacaaggtgaagcaacaattcagcgcattgtacgtcaggcaagtaagttacgcgttgtttttgcgacagatgaagagattgcagctcatgaagcccgtctcgatctggtgcagaagaaaggcggaagttgcctctggcgagcataatttaatatcagtaaaccggacataacccatgaagaaaaatcgcgcttttttgaagtgggcagggggcaagtatcccctgcttgatgatattaaacggcatttgcccaagggcgaatgtctggttgagccttttgtaggtgccgggtcggtgtttctcaacaccgacttttctcgttatatccttgccgatatcaatagcgacctgatcagtctctataacattgtgaagatgcgtactgatgagtacgtacaggccgcacgcgagctgtttgttcccgaaacaaattgcgccgaggtttactatcagttccgcgaagagttcaacaaaagccaggatccgttccgtcgggcggtactgtttttatatttgaaccgctacggttacaacggcctgtgtcgttacaatctgcgcggtgagtttaacgtgccgttcggccgctacaaaaaaccctatttcccggaagcagagttgtatcacttcgctgaaaaagcgcagaatgcctttttctattgtgagtcttacgccgatagcatggcgcgcgcagatgatgcatccgtcgtctattgcgatccgccttatgcaccgctgtctgcgaccgccaactttacggcgtatcacacaaacagttttacgcttgaacaacaagcgcatctggcggagatcgccgaaggtctggttgagcgccatattccagtgctgatctccaatcacgatacgatgttaacgcgtgagtggtatcagcgcgcaaaattgcatgtcgtcaaagttcgacgcagtataagcagcaacggcggcacacgtaaaaaggtggacgaactgctggctttgtacaaaccaggagtcgtttcacccgcgaaaaaataattcagctaagacactgcactggattaagatgaaaacgattgaagttgatgatgaactctacagctatattgccagccacactaagcatatcggcgagagcgcatccgacattttacggcgtatgttgaaattttccgccgcatcacagcctgctgctccggtgacgaaagaggttcgcgttgcgtcacctgctatcgtcgaagcgaagccggtcaaaacgattaaagacaaggttcgcgcaatgcgtgaacttctgctttcggatgaatacgcagagcaaaagcgagcggtcaatcgctttatgctgctgttgtctacactatattctcttgacgcccaggcgtttgccgaagcaacggaatcgttgcacggtcgtacacgcgtttactttgcggcagatgaacaaacgctgctgaaaaatggtaatcagaccaagccgaaacatgtgccaggcacgccgtattgggtgatcaccaacaccaacaccggccgtaaatgcagcatgatcgaacacatcatgcagtcgatgcaattcccggcggaattgattgagaaggtttgcggaactatctaacggctgaaattaatgaggtcatacccaaatggatagttcgtttacgcccattgaacaaatgctaaaatttcgcgccagccgccacgaagattttccttatcaggagatccttctgactcgtctttgcatgcacatgcaaagcaagctgctggagaaccgcaataaaatgctgaaggctcagggaattaacgagacgttgtttatggcgttgattacgctggagtctcaggaaaaccacagtattcagccttctgaattaagttgtgctcttggatcatcccgtaccaacgcgacgcgtattgccgatgaactggaaaaacgcggttggatcgaacgtcgtgaaagcgataacgatcgccgctgcctgcatctgcaattaacggaaaaaggtcacgagtttttgcgcgaggttttaccaccgcagcataactgcctgcatcaactctggtccgcgctcagcacaacagaaaaagatcagctcgagcaaatcacccgcaaattgctctcccgtctcgaccagatggaacaagacggtgtggttctcgaagcgatgagctaataatacaaaaattaggaggaatttcaacatgacaaatttatctgacatcattgaaaaagaaacaggaaaacaactagtgattcaagaatcaattctaatgttaccagaagaagtagaggaagtaattgggaataaaccagaaagtgatattttagttcatactgcttatgatgaaagtacagatgaaaatgtaatgctattaacttcagatgctccagaatataaaccttgggctttagtaattcaagacagtaatggagaaaataaaattaaaatgttataagtcgagattaagtaaaccggaatctgaagatgaccgacgcggaatacgttcgtatccacgaaaaactggacatctacaccttcaaaaaacagttcttcaacaacaaaaaatctgtttctcaccgttgctacgttctgttcgaactgaaacgtcgtggtgaacgtcgtgcgtgcttctggggttacgcggttaacaaaccgcagtctggtaccgaacgtggtatccacgcggaaatcttctctatccgtaaagttgaagaatacctgcgtgacaacccgggtcagttcaccatcaactggtactcttcttggtctccgtgcgcggactgcgcggaaaaaatcctggaatggtacaaccaggaactgcgtggtaacggtcacaccctgaaaatctgggcgtgcaaactgtactacgaaaaaaacgcgcgtaaccagatcggtctgtggaacctgcgtgacaacggtgttggtctgaacgttatggtttctgaacactaccagtgctgccgtaaaatcttcatccagtcttctcacaaccagctgaacgaaaaccgttggctggaaaaaaccctgaaacgtgcggaaaaacgtcgttctgaactgtctatcatgatccaggttaaaatcctgcacaccaccaaatctccggcggtttaaacttaattaacggcactcctcagccaagtcaaaagcctccggtcggaggcttttgactacatgcccatggcgtttacgccccgccctgccactcatcgcagtactgttgtaattcattaagcattctgccgacatggaagccatcacaaacggcatgatgaacctgaatcgccagcggcatcagcaccttgtcgccttgcgtataatatttgcccatagtgaaaacgggggcgaagaagttgtccatattggccacgtttaaatcaaaactggtgaaactcacccagggattggctgagacgaaaaacatattctcaataaaccctttagggaaataggccaggttttcaccgtaacacgccacatcttgcgaatatatgtgtagaaactgccggaaatcgtcgtggtattcactccagagcgatgaaaacgtttcagtttgctcatggaaaacggtgtaacaagggtgaacactatcccatatcaccagctcaccgtctttcattgccatacggaactccggatgagcattcatcaggcgggcaagaatgtgaataaaggccggataaaacttgtgcttatttttctttacggtctttaaaaaggccgtaatatccagctgaacggtctggttataggtacattgagtaactgactgaaatgcctcaaaatgttctttacgatgccattgggatatatcaacggtggtatatccagtgatttttttctccattttagcttccttagctcctgaaaatctcgataactcaaaaaatacgcccggtagtgatcttatttcattatggtgaaagttggaacctcttacgtgccaagccaaataggccgt

SEQ ID NO: 124 - DNA, 193 bp, Artificial Sequence
  Synthetic Polynucleotide
aatgttgtcctcttgatttctgcgttcaggattgtcctgctctctatcactgatagggatgaactgttaatacaatttgcgtgccaattttttatctttttgatttataaagatctgattgaagaatcaacagcaacatgccaggatgagttagcgaattacactaacaagtggcgaatttcatcacggagcc

What is claimed is:

1. An expression construct for modulating the mutation rate of nucleic acids in a bacterial cell, the construct comprising a nucleic acid sequence encoding:
   (a) at least one gene product that disrupts a proofreading pathway, a translesion synthesis pathway, and/or a methyl-directed mismatch repair pathway of the bacterial cell; and
   (b) at least one gene product that disrupts a base excision repair pathway and/or a base selection pathway of the bacterial cell;
   wherein the gene products are under the control of one or more heterologous promoters.

2. The expression construct of claim 1, wherein the gene product that disrupts a proofreading pathway is a dnaQ926, BRM1, BR11, BR1, BR6, or BR13 gene product.

3. The expression construct of claim 1, wherein the gene product that disrupts a translesion synthesis pathway is an umuD', umuC, recA, dinB, or polB gene product.

4. The expression construct of claim 1, wherein the gene product that disrupts a methyl-directed mismatch repair pathway is a mutS, mutL, mutH, dam, or seqA gene product.

5. The expression construct of claim 1, wherein the gene product that disrupts a base excision repair pathway is a ugi, AID, APOBEC, CDA, MAG, or AAG gene product.

6. The expression construct of claim 1, wherein the gene product that disrupts a base selection pathway is a dnaE74, dnaE486, dnaE1026, dnaX36, dnaX2016, emrR, nrdAB, nrdA(H59A)B, nrdA(A65V)B, nrdA(A301V)B, nrdAB (P334L), or nrdEF gene product.

7. The expression construct of claim 1, wherein the expression construct further comprises a nucleic acid sequence encoding a rsmE, cchA, yffI, or yfjY gene product.

8. The expression construct of claim 1, wherein the expression construct comprises a nucleic acid sequence encoding a dnaQ926 gene product.

9. The expression construct of claim 1, wherein the expression construct comprises a nucleic acid sequence encoding a dam gene product.

10. The expression construct of claim 1, wherein the expression construct comprises a nucleic acid sequence encoding a dnaE74, a dnaE486, a dnaE1026, a dnaX36, a dnaX2016, a rpsD12, a rpsD14, a rpsD16, a polB, a polB (D156A), a MAG1, a AAG(Y127I-H136L), and/or a Δ80-AAG(Y127I-H136L) gene product.

11. The expression construct of claim 1, wherein the heterologous promoter is an inducible promoter.

12. The expression construct of claim 1, wherein the expression construct comprises a nucleic acid sequence encoding a: dnaQ926 gene product, a dam gene product, a seqA gene product, an emrR gene product, a ugi gene product, and a CDA1 gene product.

13. The expression construct of claim 1, wherein the expression construct further comprises:
   (i) a nucleic acid sequence encoding pIII protein; and
   (ii) a drift promoter;
   wherein the nucleic acid sequence encoding pIII protein is under the control of the drift promoter.

14. A plasmid comprising the expression construct of claim 1.

15. A cell comprising the plasmid of claim 14.

16. The plasmid of claim 14, wherein the plasmid comprises a bacterial origin of replication.

17. The plasmid of claim 16, wherein the origin of replication is a cloDF13 origin of replication.

18. The plasmid of claim 14, wherein the plasmid comprises a nucleic acid sequence encoding a gene product conferring resistance to an antibiotic to a bacterial host cell.

19. The plasmid of claim 18, wherein the antibiotic is chloramphenicol.

20. A method for modulating the mutation rate in a host cell, the method comprising contacting the cell with the plasmid of claim 19.

21. A method for modulating the mutation rate in a host cell, the method comprising contacting the cell with the plasmid of claim 14.

22. A cell comprising the expression construct of claim 1.

23. A method for modulating the mutation rate in a host cell, the method comprising contacting the cell with the expression construct of claim 1.

24. A method for directed evolution, the method comprising:
   (a) contacting a population of host cells comprising the expression construct of claim 1 with a population of phage vectors comprising a gene to be evolved and deficient in at least one gene for the generation of infectious phage particles, wherein
      (1) the host cells are amenable to transfer of the vector;
      (2) the vector allows for expression of the gene to be evolved in the host cell, can be replicated by the host cell, and the replicated vector can transfer into a second host cell; and
      (3) the host cell expresses a gene product encoded by the at least one gene for the generation of infectious phage particles of (a) in response to the activity of the gene to be evolved, and the level of gene product expression depends on the activity of the gene to be evolved;
   (b) incubating the population of host cells under conditions allowing for mutation of the gene to be evolved and the transfer of the vector comprising the gene to be evolved from host cell to host cell, wherein host cells are removed from the host cell population, and the population of host cells is replenished with fresh host cells that comprise the expression construct but do not harbor the vector; and (c) isolating a replicated vector from the host cell population in (b), wherein the replicated vector comprises a mutated version of the gene to be evolved.

25. A kit comprising:
(a) the expression construct of claim 1, wherein the expression construct comprises an inducible promoter controlling at least one of the nucleic acid sequences comprised in the expression construct; and
(b) an inducing agent that induces expression from the inducible promoter.

26. An expression construct comprising a nucleic acid sequence under the control of a heterologous promoter, wherein the expression construct comprises the sequence set forth in any one of SEQ ID NO: 27, 28, 29, 33, 34, and 35.

* * * * *